United States Patent 7,507,875 (TRANSCRIPTION FACTORS) - sequence listing, part 2

SEQ ID NO: 1791 - DNA, 1076 bp, Eucalyptus sp.
aagtgaatgtgggacggcaaccgtatagcatggcagaatcgacggaggcatggccagtgggactcagattcaaaccgacggagaatgagctcatcagtcatcacttgacaaaaaagctcaaaggagaaatggaaactatttgcgtgattcccgagctatacatctacaactgggagcctccggagttatttgcacgatacaaggaattgtcaagtatcccatcggatggaagcgagtgtttcttcttttgtccccgtggtcgtaagaggaagaggaagaccgagtgcggattttggaaagagacatattccaaacgtgttatacaagcaccagacaccggtgaggagatagggctcaggagaggcttggtttaccacaaaggtcgacaaagaaattcccaaaggaccaacttgggcatgaccgaatatcacctaaattcgaatgtttcagatagtgaaatttcagacccggcggcgatggttctctgtcacataataaacaggaaaagtaagaaagcaaagtcaccaacagcaggtacttcaactgatttaagcggccctagaaatctgaatgattcccaaaatgaagaaacacaagatactagtgaacgggcatctcctggagttactgttgaattccctctgaatgagacgtcaaatttaaattttccaggccagaatgtgcctattcccgatcagcagcctcaaacgaccaaagagcaatgtttgtctcatgatatttacgagcacgatgaacccagtgacggatattgttctctgccatattcttcaagtgactatattgatctcggggatctctttaactttgacgagagcattaattagtatgccaaacttgagtgatattgccagtgtttgaggacatttataaatgttaatctcagccttgcttattgtatcagtgataatgccgtgtaccaactatggttctcctaggataggatattatatcaatcttgtaagcttgtatgcagtattacttctgtttcctttcaatttgtatattaatgtcgattttacctactcaatactggtcatgcataaataaaaaaaaaa

SEQ ID NO: 1792 - DNA, 1089 bp, Eucalyptus sp.
ccgacagcgtccttcgaaacttaagaaaggccaaaacagaggtgaaaaaacagagagaggtttctcaggacttgtgcagtgcaagaccgagagtcagctcacgcgctccggtactccatggaagagccgaccccgacgccggagctcgagctcccgggtttccggttccaccccaccgaggaagagctccttgatttctaccttcggaacatgatttccaacaagaaactgcggttcgacgtgatcgggttcttgaacatctaccactacgacccgcgggaattgcctggcctggcgaagattggtgaaagagagtggtacttctttgtaccgagagatcggaagcatgggagcggcggtcggccaaaccggaccaccaagcatggtttttggaaggccaccggctcggaccggaagattgtgagtctatcagaccacaagagggtactcggcctgagaaagaccctcgtgttctatgagggaagggcgccgcgaggaaccaaaacagattgggtgatgaacgagtacagattaccggatgactcgtcgcccaaggaaatggtgttatgcaagatttacaggaaggccacctccctgaaagtgctggagcagagggcggcgatgggggaaggcatgaataaggccgccactgctgccgttgctcacctgtctcctccatctccattctcaccgatggagacctcctcgtccttcaacactcagcaatacgacctgatgccatcaatgcgcgagtctaagattgtgttcaagcaggaactgctggaggaggcggaagatgaacaggaagtgcaaggtttcatcacaagcccaccacaagatcttttcgtgaacaaagtgatgagcaaagggtcgtcctcttcactgcaaatgccgactgggaaggagaaattgccggagctgcaactgcccaagatgcctgcagactggacgcaggacaacttctggactcagttcaacagcccctggctccagaacttgaacaccccttatttaacattctgaacttctaatttgttgatcgaccagagtctaattcaaagcttagtggttgtagatcgaaaaaaaaaa

SEQ ID NO: 1793 - DNA, 1166 bp, Eucalyptus sp.
gcccaagcgaggcgaagcaaatagtaagctctgtttcccctgtgttttcccctgctcctgcaagtcgaatacactcatcttctcttggtctgttgcgggctgaagttgagactggtaggcatcatcagatcggatggcggcatggccggtgggactcagattcgagccgaccgaggacgaactcgtcgatcatcaccttagagggaagctcaagggaaaactggaagcattctgcctcatcccagagctctacatctacagttgcgagcctccggatctgttcatttcatacaatgaattatcggctataccgtcagacggacgggagtgcttcttcttctgtccttgcggggacaaaattccaaataatcgtcgttcgaataacaggatgacagaattgggattttggaaagatacctgtaagaaacgcgttatacgatccctggtcaccggcaagcaaatagggatcaggaagattttggtttactatgagggtcgacaaccgaaaggccgcaagaccgatgtggtcatgcatgaatatcacctaaactcaagtgtctccgacagtaaaatctccggccagatggcctttgttctctgtcacataatcgacaggaaacgcaagaaagcgaggtcagcaaaggcgtgtgcttcggccagttcaagcaccatcagtactcctaatgactccggaaatggacgatccgacgaagttagtacagaggcatctgaggaagtaacgatcgaaacccaaaatcagaacgagatattgatttccagcatgccagacgataatgggccaattatccctcagcaggaccatatgcacgaagagcaaagccctctttatgatggttgtccgtttatagatgggcatagtgacgaattgtatgatctgctatattccccgagcaacggtatggagatcttggacctctggaatgtccctacggatgaactagtatgccaaagtttccttcccggagaagaatatgatggacttacttttacctagttaccatgttgttgacataagagggatgggagatgggtgtgctgtaaaaactgtagctgggtgagtggagattgtgtgtgtatggtacaaactatgtagtgctgcttataacagtcaggttgtgaaagtatggacacttcagtattatgtt

SEQ ID NO: 1794 - DNA, 2067 bp, Eucalyptus sp.
acttgtgtgagagaagaaaacaagatatggaaactaggatgtccccaatgaatttagtacccgcagaaaagatagtcacagagatggcactactacttcagcaggcgatagtcggctacagattccatccaacggaggaggaactaatcaattacttgaagtcgaaagcaaccggatgcagagaaactctctccattattccgacactagaaaacatctacgaaagtaatccgtgggatttaccagccaaattcaatgagaaatcgatcattcgatccagagatcaagaatggtggttcatatgtccacagacgcagaaccaacggattggcaggaaaacaccatgtggttcttcttggaagatcaccggcaaacataaagatattaaggcagaaaatgacggcaaaaagatcggtttcaagatcacattagttttccttgatggccgaaattccaagggcactagatccaactgggtcttgcatgagtttcatttgcatgcagatgatatgggtttcgttctttgtttcctaaagatgaagcaagatgagaaggcagataaccaagaaccatctatccaggcattgaggaaccaaccaaaccacgcagctatggcaacgaatggagacttctcatctactccacagtttcagtgtcccaaagtttctttcagtgagctaatcaagaatggaacaaaatccgtagcccagataccagaagacaatcaccactcctcacctaatctggagcatctcacgtggactaaaaattcctctagtatgggaaattcatcaggaagggggcttgctgtatcccctactaatgatgagttaaatttcccatgtcattttcttaatgttgatgtttgcagtgcaattgaagctcaaacagaaaaaatgtatcgggtaaatttatttttccagtagcacattagatttagtgtaaatgagtacattgtagaagataatgtcatgaactcgagcataaattttgtatggcaagacatcaaaagtttgtcaaaactcctacaggtagtctgatagctaacgcagatgcgtcattccttttgaaaaagaaatgtaactttttccgcatttcagaaaaagatatttgtgatctctcattcgccgagtccttgtactgctggttatgtgctggctttgtgacggcattgggatgtcttgttttctccacagcagaaggctgatttagttcattccttagaggagaaggtagatgagacgtctggaacttcaaagtttattggtgaacaagcagataagagctgtgatggcatggattgtgataaccccgaacaacttccttttgcagaggaccaaccgaatgagctaatcatgaacgggagctcctttagtgctgaaaactcatccagaagtggcatgactattaccaacgaacagagtaggaacgagccctggacgtcccctctttatcatcattcatttcctgatggcaaacattttaatttatatgatctgcttcatgaaactgaagcagacataggagtaattcagcatggccaacttggagaatttagctgggactatcattgggctaataagaaccagcggcctgtctatgacactcttgagggagctgttgctttagaggaagaggaaggatttgttgaacagaaactcaaccatcctcatgacactgaaaagatcataacagagtgtgcatcttctgatggagcaccagcaaaagcaaaggcacaagcttcagagttcaaagagaaggaaactatcatgattcagccacagcagaagtaccacgtgaagattgaatcgaataacatatccaattgggagaaccggaataattcactgtcaccaacgagatcaactgcatcaaccagctgtcgctgccgaaataaatccaccattgatccaattgagcttgccttgttatttgcacttgttcttctggtgtacgtgattgttgagggaatatgaagaatatctgatgaaatcaactagatgatacaggtctatgtgttaaaccagggattttgctggagatttcaacaaaaaaaaaaaaaaaaaa

SEQ ID NO: 1795 - DNA, 1428 bp, Eucalyptus sp.
cacacgcacgcagacggacgagctcctcccctattctgcggcttcttttataaagtctcgctgcctctctgcctgtctgtccctctctctctctcttgttgcctcttgtttcttggttttctcttgcttttcttttgggttcttcccagccgctttacctggggtcttcctgtatttataagaagtctcctcggatgggttcgtcgaactgagtgagtgtgtgcgtatctccccctcggaacggttaatgaattgattagaggcgggagatttttgagggatttgaagagagcagagtgagagatagagtcatactaggctgtaattttacaagagacacagagagaatggagaaagtgagttttgtcaagaacggagtgctgagactgccgccaggattcagattccaccctacggacgaagagctggtggttcagtacttgaagcgcaaggtcttcgcttgccccttgcctgcctccttcatccctgaggttgatgtctgcaaggctgacccttgggacttgccaggggatgcagagcaagagaggtacttcttcagcacgagggaggccaagtacccgaacggaaaccggtcgaaccgggccacggtttcgggatactggaaggccacggggatcgacaggcgggtcgttagctcgaggagccatcaattggtgctgggcttgaagaagaccctggttttttacagggggaaggccccgcacggctcaaagaccgactggatcatgcacgaataccgccttgtcgacggcctagcgcccggcactgccctgccgcccaaaatgaacttgaatcagagccctgaggtgccaagggagaattgggtcctctgccgtatttttttcaagaggaggagcaccaaaaatgatggccacaatcacaacatagaaagctttaggactaccaatgaagttagcaaagtcaggggaaacgggccggtcttctacgatttcatggctagacataagaccgacttgaatctcacgccatgcacctcgtcctcaggatcaagcggcgtcaccgagttgtccttgcgcggcggcccggaagagcacgaagaaagtagcagctgcaacagcttctctttatcccggagaataccgtaacaatgctccttgatcagcactctcgagtcggaatctcagtaaaacccgtgtcagtcagtgtttcgagtacgaaattactctgcatctcgcccctgggattaccttaggtcgagttctgagatgtacgaacgagggaaagcgaagaagtcggcatttacgatctactgtttgctgctaatatatatgagagcccattttgtattattagcttatagtggtagtcgatcatgtaatctgattcccccaaaaatttcaattctagtgagctgctttagtctcctcttcttcggcaaaaaaaaaa

SEQ ID NO: 1796 - DNA, 2028 bp, Eucalyptus sp.
ccccgcaagcaccaccatcaccatcctcctccaatccctctctctctctctctctctacgattctctgtttctctctcttctgcgaaccctaacctcggaagacctgacgatcggctctccatgggacgcgataaggggaagtcgctggctccggggttccggttccaccccaccgacgaggagctcatccggtactacctcaagcgcaaggtctccggcaagcccctccgcttcgacgccatctccgaggtcgacgtctacaaatgcgagccctgggatctccccgataagtcgaaattgaaaagtagagacctcgagtggtacttctttagtgtgttggataagaagtatggaaatgggtcgaagacaaatcgtgccacagagaatggttactggaagacgacagggaaggaccgggcaatctatcattactctcgaacagttggaatgaagaaaactttggtttatcataatgggcgagctccgcgtggacagcgaacgaattgggttatgcatgaatatcggcttactgatgaagaattggagaaggctggaattccgcaagatgcgttcgtgctgtgcagaatctttcagaagagtggttctggcccaaagaacggggagcaatatggtgcaccgttcattgaggaggaatgggaggatgatgatgtggccctgtttcctgatcaggagcaaatggtggttgttcatgatgaatatgttgaggcagatgacttggatcagagtattgaagttggaactgaacctggagatgctccagttcctctgaacttctatcatggtgagacaagccagggcactgagcattcaaatgacctcaatgaagatgagcaaaagcctctgatagataccaatgcaattcaagccagtttgcaacagcaggatgagcagttttttgttttaccagagcagtaccggacagagatgaaagccattgagaatggatacattggccaatcagatgataatgccaatcctgtggatgccaattacttactcgatgagccatacttagatgtagctggagatgattactacctccaaacaaatgaccttgctaatctccttggggaggatgcagcagattttgatgttgaagattacctaacattctttgatgcagatgatgagaatttgttgccatatgaatcctctcaacctcctcctgaaaatttactttctgaccacgcgcttcatgctgagcatattaatggagaaaatgaggaagctcctctggcaggcaatcttccttcagaatcttgcagtaaggactgtgcgtccacttcaaagccgcatttggattcaaaagaccctgaatcaagtattaaatatccattcatgaaagcagccagtcaaatgttagggagtttccctgctcctcctgcttttgctgcagagttcccagtgaaagatgcggcactccgtctcaattcggctgcacagccttcaagttctgttcatgttactgctggcatgataagaattagaaacatgaatttagtcggcagtggaatggactggtcaatcgggaagaacggagaactcaatatcgttctctcttttgggatgtctcaagctgatatcagccctactgattctggcctgcgctctcgcaagacaccatcagtggcttcatggacctggtgcttcttgttcttttggattatacttctctcggtcggtgttaaagtcgggacctcaatctactcgaggtagtaggatactggagaaggtggcaatctcggccactgggatggagatagtggataaactcacataggaacatactattctagttatcattatgtaggacccttgacatattttgcttaagttattccgtgtccagtgcaaactatcactcggtcttttttaatctgtaccgacaatgttaaaccccgtggatgggtatctgtcgtggcgtttgttgtattgctacagcccatggataggattggaatcatcggatcaatatgtatggcgcctacatttttttaaaaaaaaaa

SEQ ID NO: 1797 - DNA, 2509 bp, Eucalyptus sp.
ctctctctctctctcacatctctagttcagcctttttcctccatttggccaagcagcgcccgccgcgcgacccgaaggcttccggatctggtgctcgttgctattccgtccgtcgataggaggctaggctacgctgaaagaagttgatgagcgcaatttcactgatggagtggaatgcgaaacctcctctgcagtgggaatgggagaatcttatgatgttcggttcaaaagcgactgaaacctctaagccgctgcgagcgactgattggggaatcgaggcggaggagctgattgaccccgggtccttatttctgtatgagaatggtggcggcagcagcagttgtaccagcattgatccgggttacacttctgtgtccaagagctcgaaatcggcttctgtcaattcttcgtctacggacgaattgaaaatctcgaaattctctgtggaggcgcatgaaggcttttctctgcagagtagcaagaaagaattggcggtgaatgattttaccggaatgtcaccggcactcgagccttcggtctgctctggtgagccactgctcagtctaaagctcggtaaaaggatatattttgaaaatactattgacaaggatcatgtgaagacccaagaccttccttcggtcatgaaatcacctgatactccagcaaagagaaacaaatccaactgtcagggtacgtccgccccacgctgccaagttgaaggctgtaaccttgacctctcttcagctaaagattaccaccgcaagcatagagtttgtgagagtcactctaaatgccctaaggtcatcgtcagtggtatagagcgtcggttttgtcagcaatgcagcaggtttcatgggctatctgagtttgatgaaaagaagcgtagctgtcgcaagcgcctatctgatcacaatgcaagacgtcgcaagcccccgccggatgtgacccagttgaatccggctagactgtctgcactgttttatggtgggatgcagcagttgaatccagtcttgagcagagctccagctatccacaccaggtctactgctagttttaaatgggcagatacacaggacactaagctcatagagaaaggtccgaagcttccaataggcggaggtgttggtgagtgtatcactatcccaagcaatgggataccggacaccctcaagtccactggattgggtaaaagctataacgaacttctatcatcaaaaggcatgccagtcaaaactactggtggaggtatgacctgctacattttttgtgctttacaactgcactttgtagcttttatttcgtaaattatacatgatctagctgattacactatcagttgatttacaaaactatattccttaatggacattaatgtgggtctattgatggaaaaagatcgctattcctcggatcatctggatttgctctgcagatgcacttgaaccttacatattatcagcggaccatatttatgattttgattcaacagaactcgcatgcttggtctggcaatttgcttctactcaaagcttttttgtcattatcttctgattagagttctgtaaattttcagaaagcttctctaaattcttggtaattgtagatgattgaggggcttcattagcactgtttgatatgggactgtatagattaatgcatgcatgatttcaaagtattgtgaaatgtcgcctggtcaagacagaaagtcatgagtgctacttaagatatggttttgaatctgacagtcatactaaaattattcgagcaattgtgtttccttcccatggctatgactggactctcccaatttggacaggtttaggggaatctctggcatctcccaatttggacccatcgcaaaatattcaacgtgctctctctcttctgtcaaccgattctcgggatccaatcagacaaaaatcggcatcgcatgagcattctgttcatacaaataacaattgcatgagcagggatcagtcatcaatgtatggttttggccaaggctcaaggctggcttcatctggatactggcatgctgaacagcggccgaagcattcccaaactcacatcttgaatcctcacaatgagagcaacatcatcagctttggcggcagcagcatgcaagaatgtctgttctcggaggcacggcatgaatttagcttcgactccgcccaactgaactgactacatgtgggcatttgaaactgcattttcaggtaactgtggcatgtctttatctttcttgtgccggcgcagtcatccagctccattttctcaggtcagactcggtgatgggggtgaatagatacactttggaagctcctgcgcccgtcaggcaacctaaatgcacggattccgtgaaacttctcgcgaaaaaaagaaaaagcgtcactaagttaacatctcgtactctcttgttgtttgcaaatgttggaactggctacgcactgtttacttgcaacagattgctcaaatataaaactcggtcatgtttgtgctaaaaaaaaaa

SEQ ID NO: 1798 - DNA, 1680 bp, Eucalyptus sp.
ttctctctctctctctctgaggctgacacacactcacacacactgtctcacccaaattgggacacattatccgtttctccgttgcgcctctcaataatttccacaatagaaaccagtctctctctctctctctctctctctctctctctctgcgctgcctcatagtgcaaaccgttgttgggtttggagacgctcatggccgtgagatgaagctagacaggctgcaagtgagtaagattatgtctttgcagttcttgtgacgttgattctggggatctctcagggaaacagtttgactctcttgccatgtccttctttcttgggctgaagcacatcataatccatggatgataggatgagacagagcttgagtaaggggaagaaagaagtagaaacagagaaggaaattttatgggctgcaacctcacagctccttggagttgggactaaattgaagccaaggaaggattttaccggattggttcagttttagggttgtgctgcttggagctacataacagagggattgccttgtggattcaagctcaggagtgggggagttttgaggaggaatctcgggagaagctggacaatcctgcagcttctttgatggattcgtcatcaaatggatcattaaagcgggctcgagcacctggttttggtagccaagttgcttcttgcttagttgatggatgtgattcggaccttagtaagtgcagagactatcatcgccggcacaaagtgtgtgagctacactcgaaaacccctaaggttatcattaggggtcaggaacaacggttctgccaacagtgcagcagatttcattcattagcagaattcgatgatgtgaagcgaagctgcagaaaacgtcttgatggtcacaacagacgtcggaggaagccacagcctgaccccttgtccctgactgctggccggttcctcccgagtcaccaaggtaccagattttcacctttcagtggtccgcagatgtttccagctagtgctttagcaagctgctcttggcctggagttgtcaaagtagaggatgacaccacttcttacaacacgcctcagctcattaacttcaatgaacgaaatctctccttcccgggatcaacctcgtctcacttcaaagggcatatacaatttcccttcttgcaaggaaccagtgccgcacaccttggagcttcaatatgtaagcctgccctcaaccccaattccactaccggaactggtggtaatggtaacaatgccagatcctcttccagtggcttaaacagagttgtcgcctccgagcgtgctctctctcttctgtcatcaccaccagccgagaattccgagaagggtttaagccgcatgatgcagctcgtcccatccacctctgctcaatcattgaccaccgacttgcgctacaatagattaggacttggcaagcccgggaatcctggtatggattctgagagcactggcagtggggaactccattaccatgggatattccaatctgagcatgctggattatctgcaaatggacagcaccagactccctctttctcttgggagtagtatttgccctttactagaataacccggtggagcttcttgaagacgtataataaatgtagtgccgttccaagaccttgaagttttacatgttgcattaaatgttcttgtatatag

SEQ ID NO: 1799 - DNA, 2296 bp, Eucalyptus sp.
ccctgttcactgtgttcttggaactgcgaccacaccaacaccccctctcttccttttcttgctctcatctgctcttcttgaatttacccttgttttccccctctcaccaggttcacttcaagattgggttcacgtgggtttcaagagattcatctttgttttcgtgccctttttcctttcttttttttaactgaggcctgaagccgtgagctcggagtgttgtttcttggacgcatggtccttttcttgaacgataatcttgtccaggatctgaagattcttggatttgggtttcgggaagggaagctactgttacagtgctcgagaagttaattcagctggctagtgggttcctttaatttctaggaggaattttagtttagcagtaagacttttttgttcgtggggttggggtagaatttttgtatgaatcctttaattctgaaagtgagtttcttttaatggagtcgtggagctatttttctgaagggaaggctcttgtatcagatgagcctgtctcgccatttgatttgcttggaaggagcaagaatgctgtcgcgaattgggaactgaggagtccgcctagttttggcaatagtgtagtcgtctcgggtcaagaagcagatgttggccaaggtttcggtcaacttggttttcaagaaataatcaggaagcaagttcacccaaagtcccccaggcatgtcttgactgataaatttgatgatgggaatggtgcaaatcagattctggctgccttggattcttttgggggagaagacgagtccacttcaaatttatcggtctcgggggttgactccaatacccaagattcattgctcattgacttgaaattgggaagatttggtgaatccagggaagttcccggcgcaaaattccctcaaggaggaaaaaaggttttatcttcttctgaatcatcgacacctcccaagcgagctcgatctgttggatcgaattgccatacccattattgccaagtttttggatgcaacaaagatcttagctcttcaaaagattaccataagaggcataaagtgtgtgaggttcactcaaagactgcccaagtggttgtaaacggagttgaacagcgtttttgccagcaatgtagcagatttcatttgctagctgaattcgatgatggtaagcgcagctgtcgtaaacgtctcagtgtccacaatgagcggcgccggaagcctcatgttggggttcagtctggtagtgttggcaggatgttgcagtcatacaatggtagcgggcttgagagaaatctgttagcgccaacctccttcctctgccaagatacacttgctggcgaaaagtttctgaattctgggccatatggaatgaataattggtatgagcacatcaaagctgaagatggaattggtcttggtcccccatcagctattcccaccccaaacaggcatccaaatgcaatatcactgatctctccttacaaatttgagagacaatttgccctctttgatggaggcagagtaaaatccacagcatctggcatttccagtaaaaataatcaggttccacgtgagctgggtgggcaaaactcttcacattcttcttttcaaaacacctccttcggtagtgaggactttgctgttttcgacacggcatcgactgtacaaggaatatcggggatcatagaatctggccgtgctctctctcttctgtcatctctatctcaaaattcttcaagccactcccgaattcccatggctcagtctttggtcatggcaggcactgactatcatttctctctgtgcggagcaaccgacaagctagtggatatgagttcgcatgcttccgtaggggtggagttgaaaaaattgtcttcatcggtgatggactctgcagaaagaaacctcccaggtcatcccttggtttctgatttggagatcactgatgggattctggggggatcaggttttgtaaactccaaagacaatctttctcctgaaggtggtgctactacaatgaacttgcttcagttgtcatcacaacttcaacgtgtggaggatcaaaggcaatccatccatttgaaggagcaaaatgatgttttcggttgtcacagcatcacttgagcattccaagacaaggtacaaggaaatccttggaaccttcatttgctcaatgggtaggtagctcctatgtttctctcatattcagtttgctttgtcaatattccctttattggaaatcaactgtatatactatgagaggagaaattatttaattttttttcccgcttctaaaaaaaaaa

SEQ ID NO: 1800 - DNA, 3202 bp, Eucalyptus sp.
ccgaaatccatggagccgccgccgtccccctcctccccccacctgctcccctccatggacctccacgcgccgccgctcctcgacggcgccgccgccgacgccgccgactgcgtctgggacttcggcgacctcctcgatttcaccgccgacgacgccctgatcagcccctgggacgagccccccgcgctcgacaacccggcctccgtcccctccgacccggatcccgaccccgctcccgaggacccccccgccggcggcgccgccccgccggcggcgacccgggtccggaagcgggacccccggctggtctgctccaacttcctggcggggcgcgtgccgtgcgcgtgccccgagctcgacgcgaagatggcggaggcggaggaggaggaggcggcggcggaggggctgcacacgaagaagcgggcccgggcgccgaggagggccggcacgggccaggggatcgcccggtgtcaggtcccgagctgcaaggccgacatccaggagctcaaggggtaccaccggcggcaccgggtttgcctccggtgcgccaacgcgtcggctgtgctcttggagggggataggaagagatactgccagcagtgtggcaagtttcacttcttgtcagactttgatgaaggtaaaagaagttgtcgaagaaaactagagcgccacaacaacagaaggcgaagaaagcctgctgattctggcagtggactagtaaaagaatctcaacaagatattcattctgaagatgttggctgtgatgatgaagatgggaaagataccttatgtttgagtggccagtctgttgaaaaggaagcctcgttagagcctgaagatggaggagcatctccactaggatctgctcctgagtgtcagataatttcaacagatagcattgcgtctgctgtttctcgggaaacccaaatggaaagtaggaaggataattcgaaatttgcgctttctccttcttgtggtgacaataggagtgcatactcatctgtgtgcccaacaggtcgaatttcattcaagctttatgattggaatccagcagagtttcctagacgtcttcgccaccaaatattccactggttggcgagcatgccggtggagttggagggttatatccgccctggatgtgttattttgacagtgtttatcgccatgcccaagtttatgtggggaaagttatatgaagatccaatatcatatataaatgaattcatccttcgacctggaagattgctgtccggaagaggcactatgtatatctttctaaatgacatggtattccatcttaaggaagatgaaacttctgttacgaaggttgagggggggtttcggacacctaggcttcactatgttcatcctatggtttttgaggctggcaagcccatggacttagttgcttgtggaagtgatttgctgcaaccccattttcggttgagaaccagtctggcttgtcgaacttcattcctgttctcatcggtaacaaggaagtttgttctgagatgaggatgttacagcagagagtagataaatctctcttaaatgaggggcctcaaatttcggacatcgtaatgtcccagattcatgtggggctttctcacagagacaagccacactttctgagttcatcctggatatcgcatggctgctgaaagaacctgcttctgaaaatcttgaccacagtttttctgtgttggagattcaaagattcagctctttgttgagctttttgatgcaacatgattcaagcaccattttggagaaaatattgcagagactggactttcttatggagaatatcgaattaaccagtgaaattagtagtggcaataatgatgctgatattagatcatttaatacccaaatagatcaagcaagagaatttcttaggaaacatcagtcatccaagagggcagtgctgcattcagaacactcaaggcgaaaagaggaatgttcccatcaaggtttctctcagaatgatgtgctttcagctgtgaccaacgctaatcaggatatggagaagggggagagctacagggtagaattgatgacaggttacacttactcacataaaaatgaggcagctccacttttggatgtggagttggtcatgaatgggaacctgctcaaggaaaagccccggagtcgaatgctcctcagctctgttttgagatctcgtcctactctattcgcagtcgcaactgtcgccgtttgttttggagtgtgtgctgtcctcctccatcctaataaggttggtgaatttgcagtttctattcacagaagcctctttgaccgaccataggggaaattgctcaagatcttgatctcacagtatgtacatagtgtactcaatgaccctgacgttctcttgtcggatcaagctaccagtcttttctcattattgggagctttgatggtgggagatagctctgcctcagttttccatcgggtgcattgtcactcaaacacaacctttggattatagatgtgacgaaggttattgcttggtggagattgtaatttcgacggggactcacctgattagcagatatcgggaaccgcttagtatgcgctcagcagatattgctcggctgtttgttgtgacaactgagagatttaaccctgtttaatgactccaccggacgttcaactgtgcattagcagcaatcaggtcaggaatgtacagtccttgtaccttattccctttcttcctaattcaacacaatgtggctatctgcaaacattcctgacttcgagaagaatcgaaaaatgtacgtgctttgtgatttctgaaatgggaatagtgttggcagcaggattcgctttctccgttgtactggtatcagaaaaggtagtgaggctttgggttggtgtcatggtcgttgttgatagtctttcacttaaaaaaggaggaaagacgtcaaattgtgatgtagcttcttacttttgttgtttattcatttgatgctttttctgtcctataaataatgtagcatgaaggctccaaaagcttgtttcgtattgttctcttgtcatagaaggagtcgtccacgtcctgttcagtttctgtttgacgaacagaaagtacaaggaggcttcaggaaagctaaagggagcgtttttggcttcgaattatggctcaaatcggacattctatcatgaatttagaactcctattgtgctaaaaaaaaaa

SEQ ID NO: 1801 - DNA, 1400 bp, Eucalyptus sp.
accgacgctattcccccacccctccccccaccccaaaaaaatctctcccttttccgcgatcgaccgaaaccctagctccgccgccgccgccgccgccgccgccgttgctgctccggtgaacgaccgccgacgccgacgccgacgccggcgaggaggaggaggaggaggatgggggacctgatcgagtacgtgtccccgtcgcccacacagggcgggggcgggggcgggcacgggcggccgctgccggtgcgggaggactgctggagcgaggaggcgaccgcgacgctcatcgaggcgtgggggcggcgctacgtcgacctcaaccgcgggaacctacggcagaaggactggcaggaggtcgccgacgccgtcaacgcccgccacgggcactccaagaagacccaccgcaccgacgtccagtgcaagaaccggatcgacaccgtgaagaagaagtacaagatcgagaaggcgaggatctcgtccggcggcggcggcggcggcgcgtcgccgtgggtgttcttcgaccggctcgacgcgctgatcgggtccagctcgtcgtcgtcgtcggccgggaagaagccgtcgccgtcgccgtcggtgtccccgctgtcgccgccggtggccctgccgctgccctacaagaagacctcgtccgcggtggtggcggccgtggcgctgccgcagaagaggccggcggagagggtggacgagggatacttcaggaggaattactccgaggtcgcggccgctgcggccgccgcgggggtcgacgacgaggaggaggacgaggaggagagagatgaggatagggatagcgaggaggacgaaggagaagggatgaggagactggcgaaggccatcgagaggttcggagaggtgtatcagagggtggaggctgagaagctgaggcagatggtggacttggagaagcagaggatgcagttcgccaaggatttggaagtgcagaggctgaagatgtttatggatacgcaggttcagctcgagaggataaagcacgtcaagcactcgggctctgatgatatttatagctagccttatggaagtgacgccaatgtcgccaccgtcgcgtcgatccctgtgttgtacttactaagtgcacactgaagtccagctgcgtcgcaaaattataggtggagaagattgtcggagtaatttaaagttaattttgcaaacctaattatcgcatagtttttcttgtgcaatttctgcctgccctactagttgtactaccgtaacaatgtgagtctgttctttttctcttttcgtcttcctttgatttttccctttcttctttactcatttttcttgttagtgtcgtctctaggaatccctgttaatgaatgatttaggtgagttcgactctttaattaaaaaaaaaa

SEQ ID NO: 1802 - DNA, 1980 bp, Eucalyptus sp.
cttgagaaaaaagctcatcgacactccccatctccttttcagctgcaatatttgactctctctctctctctctgtctctctccccaccatctctctctctgctctgaaaacctaaaccaagacagaaaacaacaatggacgagcagtacggactgccggatctccggcagctcatagccactcgaaccacccaattctcctccctcctccacctcgaaccaccgctgccaccggcccctccacctcgaaccactattcacaccagcttctcaccttcttctccaccatcttcttcacactatgagcccaccgtcaatatgttgagcacagccctcgccaacacgaacgctcactccgctcacccttttgctaccgccaccccacctccttcagctctaactggtgccttcgacatatttgagtgtgggagctacaggagcgacatgattggagctgctgggacgagcggcatcagcagcagcagatggccgaggcaagagacgctcactcttcttgagatcagatctcgcctcgatcccaagttcaaggaggccaatcagaaaggacccttgtgggacgaagtctccaggataatgtctgaggaacatgggtacaatagaagcggcaagaagtgcagagagaagtttgaaaacctgtacaagtactacaagaaaactaaggaaggcaaagctggaaggcaggatggaaagaactacagattctttcgccagcttgaagcgatttacggagaatcgaccacggctaaccgaaagccatcttcggataactcgtctcttgtctccaacattaatttctacccagcaccgaacaatattagtagtcatgcattccaagatcaagctctgcaacgtgaaatgagcctcagtttctcaaactcatcatcgcatgagctcgaaacggcctcttcctcagaaaacaacgaggaagatctctccgcgattgctttcatgatgaatagcagtcattcctcagagaagaaaaagagattggtaagcgagagcgatagctcaaaaaggagtaaaaaggggtggaaggagaaggtgaagcactttgtggattcacagatgagggacatcatagagaagcaagaggcttggatggagaacatgttgaagactattgagctaaaagagcaagagagggtttgcagagagatggaatggaagagggaagagacggcacgtttcgactgcgagcgtgagctctgggccaagcaaagagtctggatcgaggctcgcgacacggcacttatggaagctctgaggaagttcacagggcaagaactggcaatcctgtcgccaccaaaggaccggaatattgcaaaagaagaagagcgaaacacaagctcattctcggagccggagatattaactttgattcagctgataacgagcttggaaccgggtttccaagaatgcggtttattaagggaaggattttgggagttaatatcggcaaaaatggcatgtttggggtataatcggagcgccggtgagtgccaagagaagtgggaaaatgtgaggaattcttttaggaagattactgaatggaacaagaagcaaagagaagacttttccaggagccagaatctattctttcaccaactccacaattcctagaaatttttatggaatttcctagaaaataagttagcctgatcagagttggaggaagatccaaaacaaaaatcacaggcttcacatcctggtgaaggtgcaagatcagttggttggggggtctcgtgtatgggaacttttaggacagcaatgacttgtaagtttggtaaatttcagtcccttttttaatttctctggagagtcgtggagtcagtgaagctcaggaggggcaataacttgtaagtctagccaattaccaatttcagctttttcaggtgtacttttggtttgacttgattgctgagaatgtggaactgatggtagttttttgtgaaaaaaaaaa

SEQ ID NO: 1803 - DNA, 1464 bp, Eucalyptus sp.
ttgtggtcagcatggaaattctgaggcctcagaatgtagatggtgtggtgggaggcagtttaaaaggaaagatacgaattacaactcgttgcttgtggcttgataaggggaagcttttggatgcgcttcataaagctgcccacgctgcgctttctagctgtcctgttaactgtcccctagcccacatggaaagaactgtgtccgaagttctgaggaagatggtacgaaagtacagtagtaaaaggcctgaagtgattgccatcgctgtagaaaatccggatgcagtcctctctcatgagattgacaataggttatctggaaagtcacatgtcacctttgggttttctgcacttaagaaaatggttgacagtagtccaaagaaaacaaaatcaagcaagaggcaagtggaagatggcaatagccactattattcagagaaatattcagagcggagttctgaaggtgaggacattgaagacagaagttttttgcacgaggaaaacactcctactacaagttccaatgcagccaaaacacaaactgcatctcccagttctgatgatttagatgattcttggaaatcatgtcttacttcatcttctgtggataaattggcaagagatgtcaacggttcctcccaaataaacgttgctgagttgaagtccatagaagatggaactgagagtaacggtgaggactccttggaaatgtcaactactcaggcaaaacattccaagcctctgaaaaggaacaaatggaagcccgaagagattaaggagttgattaaattgcgaggacagttgcacggcaaatttcaagttgtgaagggcagaatggccctatgggaggagatatcgacaaacttattaggagatggaattacccgtagtccagcacagtgcaaatctttatggacctctttagttcagaaatatgagcaaagcaaaagtggggaaagaagcagaacaagttggccatactttgaggagatggatgaaattttatctgttgttgaggcaacaacatcaaaatgattggtttcccctttgctttttcaagatgagaactctaagcaccgagaaaagtccctcggcagtgagatttcagtgcgtaaggttggccaggagattaccactggagatgatgacctgagctacgatttggggcacatatcgtgattttcatcatgcttctgccatcaggtagaggaggttttgagtaatttgttttgatcagatagaggatatcgattgatttcttatctgttatagggcctcaatgaattggatagtgatatataatatttacaagtgaattcacttgctcaatctccatctctcaattctttcttcccctttgcttatgtaaagggtggtgtagaaatcttagcttatagtatctgaggagatctttgtggagaagccctttgaggatgaaaatgcattcgttaaggtaaaaaaaaaa

SEQ ID NO: 1804 - DNA, 2087 bp, Eucalyptus sp.
ccactttagaatgtcacttcatacacggagtgactgggtgcagtaaagtcttcacctttctctttctcgaagcgcctgctttgcaaagtttcaaaaaatggctgcttgttagctgctgctcctgggtagatttctgaagaccaatccaagaatctcctcatttccaacgcccccccaagacatcaccacaaaacccaaaccccatcagaggacatcgctcgtgactgtcacatctttctttccccaaaacaaggtcaacaatcagagcattgatcgtcaccccacagacacagtcaccgacacccttgtgtactctgtttggccttccaaccacgctcgccacacacgggcgcgggtactctgtttctgtcgttctcattcttgcaagaggatgactcccaccaagaagaccatcccacgccaattctcgtacaacacgctctacgtgaaccccctgaccgacgccaggcacgtccgcagctgcagcgaagggatcgccctcgagggccactcgaaccacagccccgtcaagctcggcgaccaccgcaaggagaatgcccatcccaaccaagaacgggacgcggcggacggtgacgataaagagaacgccgttccgaaatcttggtctgcggccatttccaagcactcctcgaatctgaagtctctgtccaccgggaaagctttgaacttgaagccgtcttctctccagttctgcatgcaaatgcaagacaaagatccgaatttggggtccaaattacgggacccaattgggtcggagaactcgcattctgtgaatatctgggattactctgattcggagtcggctccagcttcgtcttggtctacattgccaaataggactttgttgtgcagaccattgcctgtggacattgggaggtgcacctgtgttattgtgagggaaaagtctatagatggagttagtggtggcactctgtattctctatacaccaacgaaggtaagggacgacaagatcgaaaactagctgttgccttctgcaagcgacgcaatggaaaatccatcttcaccatagctcagtctgtaaaaggattattatccaatggtgatgatagttacatcggtgctgtaacagccaatgtcatgggttcaaagtaccatatatgggatcagggggtctctttggactctgtagctagaggaactaaagctcttttagcagttgtaacatttgtacctaccatagccacttggacaggaagccacaggatcatgagagcgtacataccaaagcatcaatcaatgcagctgaagaacacaactcaagttccacacatcagtggactcccaaaggactgggaggaaagaagagatagagtccatcagctagtctcaagggttccacactacaataagatttctcagcaatacgagttagatttcagagacaggggaagagctggacttaaaatacagcgatcggtcaagaatttccagcttaatttggaggagaatggtaagcagacaatcctgcagctcggacgggtgggaaaatctaaatatgtcatggactacaggtaccctttgacaggttatcaggcattctgcatttgtttggcctccataaatacaaagctatgctgcacagtgtgatgacactgtgcttgccctcctgaatttgtaattcaatctctgagtacagatgtcagaagtcgtatcttcatcttttgggcgctatcccactacttcatgcagaagtagtatggcaccattttttgtagaggcaaacatttcgagacaacaattatgggccgttttagatgcaaaacgcatgcatctcgtcatcccaaatcgaagacatttccttcacttttttttccttttcgttgtttactatgctttttctacacgtttgctgatcaaatgagcctgcaatttccgatgctattttggagttagatgctataaagaatgcaaaatccttaaagagtggacctctcaagaggagaaaagagaggcttatggatatgatgggccgctgtgatcactaccataaaggccaaagcattcgggtgaaaatgatcaatttagcattgccttaaaaaaaaaa

SEQ ID NO: 1805 - DNA, 1084 bp, Eucalyptus sp.
ggagagacagaagagagagagagggagagagggagagatgtcaactactgcgacgtccacgcagggcatgctcagccaggcagcagcaccaaccatgttagaagaccagaacctgccctcgcagctgggtttctactccatcttcccgtccagcatgggctccctcgcttcatgctcgtcgtcgctttgcttcaaccagaccctcaagtccctgttcactctcccttcttccctcgtttctcccgatcctccctcgaacagtaataataacaacctcacgctcatcaccgaaaccctactttcgtccaccgctccgcacaagcaaagagagaatcttcagaccccttctgaactcttgggaggcccccagcttctgtctttgcaaagatcaaccccgaatctctgggcatggggtgagttgagtgaccagagcagcttggtcatgagatcctcatccggcggtggagatcatggcgatcattatcgtgatcacttccaccaccagagcatgggggtttcagccttgaagatgaagaagataaaggggaggaggaaggtgagggagccgaggttttgcttcaagaccatgagcgatgtggatgtcctggacgatgggtacaaatggaggaagtacggtcagaaggtggtcaagaacactcaacatcccagaagctactaccgctgcacgcaggacaactgccgggtgaagaagcgggtggagcggctagctgaggacccgaggatggtgataacgacgtacgagggcaggcacgtgcactcaccgtcgcaggacgtcgaggactcacaggcctcctcgcagctgaacgacttcttctggtagatactgatcatacgtatataagggtattcgtatattcaccagggtcgagcaataatcggcattaactgcttctttcttttcttttcttttcttttcttttctttcttgattacttgttttttcttctggtcctttttttttgcggtgaaactccgagtcaactagtggtcaaagatcacttcggtgactttcctttgattctgaagttgaatccacgctttgaatttttgctgaaaaaaaaaa

SEQ ID NO: 1806 - DNA, 1444 bp, Eucalyptus sp.
atttatcaacaacttcccttcccttcattccccttttacctctctctctctctctctctccctctctctctgccatttttcattttcatggtgttgctgccatggccgtggagctcatgctgggttaccggaacgacaccaccttctcggccaagatggaggagaccgcagtgaaagaggccgcctcgggcctcgagagcgtcgggaagctgatcaagctcctctctcactctcagatacagcacccgccggcgcaagaagcacccccgttggacctagatcgagactgccgagccgtcgccgacgacgccgtctccaagttcaagaacgtcatctccctcctcggccgcacccgcaccggccacgcccggttccggagggccccggtccaatcggccctggacaaattgccgggccagcacccccaccagcccaagatttactacgccaccccgatccagcagatcccgccgacgccggcgccggtgccggcgcttcctctcggccactatggcggctcggccgtgatatcgaagagcaacggggtggtcggcgagaggagggactcgtcgacgacgatcagcttctcggacgctagcttcccgtttgggtcgtcgttgaccgccgacaatatcagcggtaatgttaactataacaatgtgaacgagcgtcatgttgtcgtgaagcagcaacagtgctcctcctcatcgactttccagatcacgagctcctccataagcgggaagccacccctgtcgtcgtcgtcgtcgctgaagaggaagtgcagctccgagaccttgggctccggcaggtgcgcatcgtcctccgggcggtgtcattgctccaagaagaggaaattgagactgaagagggtggtgagggtcccggcgattagcctgaagatggccgatattccaccggacgagtactcttggaggaagtacggtcagaaacccatcaagggctcccctcatccaaggggatactacaagtgcagtagcgtcagaggatgcccagcgaggaagcacgtcgagagagcgtcggacgacccggcgatgctcatcgtcacctacgagggagagcacaaccactctctctccgtggtcgattcgaccagcctcatccttgagtcctcttgagacctcattcttccgtggaaggtagcatgctgattccaagaagcattcgaaacaacgggccctaatcaagtcgattggagtgcattctaatataaatagtacagccgatgtccaccgtctttcttgcccacccacgcccgcttgcaagatggacatgaccccgtgatattactataaggaggagatgcggtttttcgaagatgaaattatcgcatctgaatagtgttcctttaggggtttggtttagtgaatcatctaatcgatcgaaaagttgagtggaaaaaaattgagacccaaaaaaaaaa

SEQ ID NO: 1807 - DNA, 1016 bp, Eucalyptus sp.
gaggattcgatccgaatggaaggcgaaagaggctcgtcgtcctcctcggttccgaactacgaccttcaagtcaccttctccggcgccagtcatggcattcatgagatcgggttcgtcccgttcgaagaccagaaccaggtgctcgggttcttgacgccggcgcctcctctcatggccgccggcgagggcgccacggccgccgcaaccaccaccactagcagggttgggctgggccaccacaacggcctcgtcgccagatcgtcatggaataatgaccaggttggcgcacacgatccaaaggctgtcagcgacgagaattgcagcgcgaatcctagtgaaggcaacaattcgtggtggcggagctccacggcggcggcggagaaagggaagatgaaggtgagaaggaagctgagggagcccaggttctgcttccagacgaggagcgaggtggatgtgttggacgatggctacaaatggaggaagtacggccagaaagtggtcaagaacagcctccaccccagaagttattaccgttgcactcacagtaattgccgagtgaagaagagggtcgagcggttgtcggaagattgtcggatggtgataacgacctacgagggcagacataaccattccccgtgcgatgactcgaattcatccgaacatgaagggttcaactcgttctagtattgccccaagacagaacccaaaaagcattgtcctggtgaatttggaggacgttagcgtgtgatgatgttctgtactatcgttgcaaactgactccgacttccctggtcgtgtaatctatgtctaggagcatagttacgttgttgtacttgaacttatttgcggcttcttgtgtatatcgtggccgctacattaatttcctcttgtgcaatgtgacttgtcttccgttgtttgtgaatgcactcgccttaggagattaagttgaggatgtacgaaaacacagttctttttatctggtttaactgttcgtaaccagatctctaaaaaaaaaa

SEQ ID NO: 1808 - DNA, 714 bp, Eucalyptus sp.
acagacgctcgagattgtgaggagagtgtgctcttcctctcatcgtcgccgtcgttgtcattggaatgtccgacagtcctaacctccggtcgccggactcacaggacatggacttcaacgaccagtccgatttcgagctctcggagttcttaaagatcgatgagtggctaggtgatgatccagcttccatggtccatggggcgccggctaattatttttaccagtcgaatgaggctgacgattccatcggatctagcagcaacccggaaggccccagtcgacacgccgaaggcggaaaggagaagaaggaagttaaagaaaggttcgccttcaagacgaaatccgaggttgagatactagatgacggattcaagtggaggaagtacgggaagaagatggtgaagaacagtccgaatccgaggaactactatcggtgttcggtggaaggctgtcctgtgaagaagagagtcgaacgggacagagacgacccaaggtatgtaataacaacatacgagggcatccataatcaccaagggcccttctagtcgcacacattgcggaggccgtgatcgcatttgttaagtttcgttgaagtaatgtagaatcaaagggctggtttcggtaggagagctcagtagtcacagatagccttgtactgtatgcaactattgttgtagtataaccaagaattcttgcagcagccaaaaaaaaaaa

SEQ ID NO: 1809 - DNA, 1820 bp, Eucalyptus sp.
aggcgtaggaagcgaaaaaaagtcttctctttcacaccccccctccctccctccctccctcccccttcttcttgttgttgttccttcttgttctgcctcttgagtgtggatgaagactcttagggtttgatttaagaaccgggtgcccaacccagaaaaaaaaatgcctcttcttgggtggttttcttgccttaaataactagcgggtttcatctgatgagagatgggtgtggtgattccgtgcctggatgaggtctgtttccttttctccaagatagctatgcccagctcgacatgatctactgggtcgtctccatttctgggaaaaagggccttctctgttttcgaattttagcaagaaattgtctatctgggtcctcagctcgctgaaattggactttgactttgtgggtctctgtctttttatgttcaagatcttgggttgatttttcttttttccttcagagctgtgtggaaattatgctgtggtttccgggttggtatagcttgtaattttggtaaattaggggtttttttgtgcggcggatttgagatggaggaggttgaagaagcgaacagagcagctgtggagagctcccacagggttctgagcctcttgtcgcagccgcaagatcaggttcagtgtagaaatctgatgcttgagactggtgatgctgtattcaggttcaagagagtggtttctcttctcaatacttgcttgggtcatgctagagttaggaagttaaagaaactaccgacccctttgccccaaaaggccctcttggacaaccctattgttagaactgaccaatcttcaaagagtctccaactcctccctcctaattaccctgaaaatgcaattcaggaactcaatacacatcacaaagcctctctttctttaggtaacccgaacttggagttgagctccaatggcaaaagccctcttcatttagcccagcaagcgccatcagcacactatcactttctccagcagcagcagcagcagcagaagttacagttccagcaacaaatgaaacaccaagctgagatgatgtaccataggagcaatagtggcataagcttgaatttcgatagctctagctgcacgcccaccatgtcgtctacgaggtctttcatttcttcactgagtatagatgggagcgtggctaacttggatgcgaatgctttccatttgatcggggcggctcgctcatctgatcagaactcgcagcataagaggaagtgctctggcagaggagaggatgggagcatgaaatgcggtagcagtagtagatgtcattgctctaagaagaggaaacatagggtgaagaggtcgattaaggtacctgctataagcaacaagcttgcggatattcctcccgatgattattcgtggaggaagtacgggcagaagccaatcaagggttctcctcatcctaggggatactacaaatgtagcagcatgagaggttgccctgcaaggaagcatgtggaaaggtgcttggaggacccgtctatgctcattgtcacctacgaaggtgaccataaccaccccagggtgccatcacaatctgccaatacatgaaaatcgtggaatgcttcttgtagattgctttttcgagccctgagtcttcagcgtcttaggttttattaattggcttgaactgctcctgtacatatttttcatggcctgaagcatggggtatagatggagcagttattggctgaaaaaaggaaaagttaatgccttttggttactgtcaggtgggatttaatcttagccttgagcaagaaaaagtcgggaaatggggatctttttg

SEQ ID NO: 1810 - DNA, 4123 bp, Pinus radiata
aagtgcgacgagcgtttttgcgaggttttggagtgttgggtggtgaatgcggacgtgtacagatgatcttctgcatggcaatgggtgccattctcaggcagtaatctttatgcttccaggctgaagttcgattcgaaactgcgaagaaaataaaacggtgtggcaaccgccatgtccgcctcaaaagcgtgctttaatactaaatgcggagccacatcgactgagaaatggagagccggatggattctacgctcgggagaatttgcagagctctgcaattcatgcgggtttgtgtatgagcaaatgagattctgtgaaacatttcactcagatgatgctggctggaggatatgcagtacatgtcaaaagcctgtccattgtggatgcattgcttctgtctattcatttacacatcttgatgctggaggtattgaatgtatcaattgttccaggaagagtgacagtcatacttcagcatcgaaccaaatacagcaaatggtgccaatattgtctttatctcagaagtctgtaagtcctataaaaagctctagcaagcatataggaggcatcacagtcccaggacagtggttacaagttcctatttcagggggatctttaactagccagattgaagtaacacccacgaaaaacacatgtgaatttcaaagatcagatactattgttctaccagtggagaagcatgacaatgggcaattttccatctttggattgaaattgacagatggagacattcgtaagaacagccaaattggggaaccaaagggtgaaattcccgaaggattcagcaaaagaagttcaattcacgaggaaagagaaaatggtgaagacttctgtttggatagaaaagaaacatgtccgaggatatttacagaagaagggtttaccaaaagattgcaagagtcagaattacaaattagagtgatgggcacgaacaaatttgtgcaagatgagcattatgagccagatgtcttgaaaatatcaaaagaaaaagtttgcaccatggaggcaccagcaagtgcatgcttgaatgtgccactaagaccttttaacccaaaagaaataagtgataattcatcgactctgattacaggtgttgatcgctatcaatgtaatcctatggaaacaaaagaacaaaatcaaggtatttctacttgttcacagctccaacaacaatgccagttcattcccaggccacctgatggaagccctaatacagactctcagttaggaaatggtgtgcgttgtcaaatgcgagttgcacagatacccagtgagggaaggagccaaaatcaattacagacacgatatcggcccaggattactgaccaggaacttcaaaaaatatgtggcgattcaaactctattgttaaacctctttttgagaaaacactgagtgcaagtgatgcaggtcggataggacgcttagttcttccaaaagcatgtgctgaggcgtattttccatcaatatcacagccagaaggagtacctctgaaaattcaagatgctaatggaaaggattgggtatttcagtttcgattttggcccaataataatagtcgaatgtatgttttagaaggagtaacaccctatatacagtccatgcaattacaagctggtgatacagtgatcttcagtcagcttgaaccagaaggacagataattatgggtttccgaaaggcctcaaataccacatctaaacaggaagctcagccttcaacaacacccaatgaagcctctccaaatatgggaagtgatcctggcatttttgaaaaaatgtccacagatagcaacatttctgagatcccatttcattccagaaagcgaaacagaaaatcactcgtgaaggctcttacatcccagatttcaaatgctgggttcagtttatataggaaagaatacaaatcgagagaaagctcatctttccagtctttattgtttcggaataaaatgcaaaaccataatcttagctcaaaaagaaaaaggttacagatagacaatgaagatgccttagatttgaaggtaacatgggaagaagctcaagactttctctgccctcctctaacagctgttccaagtgttgtgatcattgaaggtcatgagtttgaagaatatgaggtacctccaatttttggaaaaaggacgactttcactaccaatcaatccagggcttcttgttctgtacctcacgaagggagttcagatgatcttgaatatcttcttcatcacagcatagacccaagaaagaagaaagatggcaaggggcagaagggtgtagatgtttcctcaggtctggatgctttagccaatgctgcaactcttggggagaagacaactacatcatctattgctgcaacaacaagacaccctcgacatagacctggctgcacatgcattgtttgcattcaacctcctagtggaaaggggcctaaacataagcctacatgtacctgtaatgtttgtacaactgtgaaacgtaggtttaagacacttatgatgagacgcaaagagcgtcaatctgaaatagaagcagaaaatacaaggaagaaacataacgttgtggaggaagagggagatgtcattagtggtaagaaaaggctatctgacattgattttcacaacgagaatggattgatgaaggaagatccagatctaacatgcaagaaaaggttaacaaaagttggcaattctataggaaatgaacttaaattggcttcagatgtaaacttacaggccttttgtaaagacgataaaggtgggaaagaagagtacattgtcagcaaaggccaacttgatctgaataatcaaccagaccgcgaggaagagctggatcaacgagagtgtgatgaacagccatcacctgagattggccaaacgagcatggtgaatcttctccatgatgccactttgcctctccatatgtacctaaagcaacatggacttccaactttgacataccctccacggatcaatcctacattacaacttcaacaaacttcaggtgaagaaagagttgaagaacaaacttctgttcaaaatgaggatcatatcaaggaagaagagttctttcctaacagaacccagaatgatacccattcaatttttgtttaggtttcctaccagatctggatgaatgcactctttctgagggtttcttctgtatggcataacaactgctgatatttatgcaagagatgatcgacagtcacttgacccggaaactgtcatcatattatttattttaccatcagcaaaagctggtgctggatgatctttttttcagtggcatgtgctgcccctatgcattactgtcctgataaaaaggaaataagttatgacaaggaaagtttggttcagcttgcaatgctatgatataaaagtcgagggtgtctctaaatttacatggaaacgtgagaattgctttagttgacaatagaaatctgaagaaagtataattttaacgattgctgttgaccatggaatagttgatcgtagatactgttcccagaatatgctgccagtgaaactactggttcatgaaggagttacagatgagattttcagcttccaaatatacagtcgacaattatgtctccatattgattgcaaagatgtcaaactcccatgacttttgggttgtattctaaattttgtttttaacattaaactagtaattttggcaggattggatggagccttgaaagttatgtttttgggatatggctccaatagttctagcagtaaaagggatagggcttgttacctgagtttcagaacatggtagattgatatcaactggaatatactgtcatttatattatgacaaggttacttgttgatgaaagaaaggatactgatctgtggttcagaatttcagttagctacccctcaataaccaggtacatcaaatccccaaggttgcatcgcctgctctggaatctatctttttcaagtatttatgcttttgttgtttggcatccagtgctatccatgacaactaatatggagcatatcaacacacgagataagtcctggcagaaatacaatgtaatataagttggtttgctattgaaatttatttttgttttatcatcttaaaaaaaaa

SEQ ID NO: 1811 - DNA, 1667 bp, Pinus radiata
gtaagtttcagtttagttgggctcttctgtacctttgagtttgagttattgcaagccgtagtttttcctatctttctgtgttttcggtaaggctgcaggagaattttgtttttggctgtttggagaattttagtgaaaagatggccggagcgatgcagatgagaaattcaaagccagagttgtttgacaacgaggatctcgtaggtgtttctggctcttcttcttgcttttcatgggcagatcaggagcagatacagatgaggcttcgaggcagcaattctgctagaaatgttccggagatgtcagcatgtgcacccactatttcaggctcctggtctgaattgctaatgaatggatgcaataacgctggagatgcggcttggtacccgagttttcaggggtcggaagccaataatcagcagcaatatgcattcgttccagaccgggctatggatatgggcttgcagtctatgccttcatctcaaatgggttcttctcagttgggagtcaattcatctcagccattgagcatatctgaaatatatgagcagattcaagccaatatacagatgcagaagaaacaacagatggatcatctacaattgcagcttctcttagcaaaaagccaccattcacagcaagtactggggtctccagcctaccattatcagcagcagcagcagcagctgaaacaattgagggatttatctttatcaagaaacctacttggggcaagagctcagcccatgaaactttctgctaaaaatgattcaaaactgggtattgcaaggcctgccaagctctacagaggagtgagacagaggcactgggggaaatgggtagcagagatcagattacctaggaatagaaccaggctctggcttggaacttttgacacagcagaagaagcagcgtttgcatatgacacagcagcctaccaactacgtggtgagtacgcaaggcttaattttccggacttgaggtatcttttgctctcaaattcggataacggtagccataatgttctttcgccaccgggtaatgcgttatctgtgctgaaatcttctgttgatgcaaagctccaggcaatttgccagcgtttatcccaggaaaattcttcagaaaatcgtctgatggcacacagtgccaacaatgaagctctggagaatgtcaagtgtgaagtttctggaagcagcaatagctcaacgatctgtggtgcagaatctgcttctatgtcacccagtaaatgtgaagtcgattcatcgactttgcagaaagcgccctctttctctattttcgctgaactggacgagtgtctcaccaaaatgccttctttggatccagaagtgatcgaggacgttctgtcctcttaaatagtgttacatttcctgtgcatatatatatatttaggctgtcagtttattaggagagccaaggctcttagctgagaccaaagatgcacgttttgtagctgcatcgatgttcatcaatattatagcagtgtctagaaatgtagaagtatagggaataaatacagccccatttgcaggctggaggatttagcttgctaattcttttagcttccagaaacctgctgtatctatatagaatgtttgcttatatattgtggcatatttttgtcatttgacagtcaaaaaaaaaaaaaa

SEQ ID NO: 1812 - DNA, 1028 bp, Pinus radiata
gtatttttgactgttctgttactcttcggatttgcatttgttcgacacctttaaaatttttgcggtggtacaggctccatcgagtgagaagcgttagatctctatatcaagaagaggatagtgatctcagatcaccatggctgtggacaccatgcagatggccagagccggtctgaagatggaaattggaggcgtcggcgtcggcggcggctgcgaggaaacggcggcgtcagctgtgaaggaaacgcatttcagaggcgtgaggaagaggccgtgggggagattcgctgcggaaatcagagatccctggaagaagacgagactctggctcggcacttttgacacagccgaagaggccgcccgcgcctatgataatgccgccagaaatctacgcggccccaaggccaaaaccaatttcgctatccacgacgatagcgccgccctgttcaacagtggcggcggacgcgccgtccctagtcagcgacaagaatggccgtcgcggccgaccttctgttccaagcaagaaccctctgagatttccaacctttctgctattcctgctcatccgtccgttccaggcaatgatcaagtttccagtcgcgttatggagaatcgggcggcctccacgaaaaggcagaagcttttgttcggcattcatcttctagaatcatctcataatctacagcaggaggaggatgcagtgatctatagctcctcgaggcggcagccgcctttcttgctggatcttaatctgcccccagctgctaacgatgtcgactaacaaattgtaaatcttataggacagttggctagggttagaactttttttttctttaaactaacctgagacgtgcaaagcttggtctatgccctctgttagcaaaacaaggggcttttgtgtcctttctccaagttttctcttcagtttcatgtacagttttgaatccaatttagatgtaaacatttgcagcgattttattgcagacgggttttccataatcagagtctattatcccataaaaaaaaaa

SEQ ID NO: 1813 - DNA, 1660 bp, Pinus radiata
atttattcctattctgggtattttcgaaatgaagaaagaagtagatccggccattgtggtgaagagatccagagaagcggagacagaggagttggggagcaagagattcaggggtgtgaggaggagatcgtgggggaaatgggtagcggagatcaggatgctccgatgccgatcccgcgtatggttgggatcctaccacactgcagaacaggcagctcgtgcctatgatgctgcctctttctgcctacgaggtcctgctgctttcctcaacttccctgaatctccacctgctcagtttctcccatatcccctgcgccctcttcatgatattcatctctccccgcaacagattcggaccattgcagctaattatgccactatgactccatcttccacttcaatttcgacttctacatcagggcttcaaccccaacaatcgaagcctatggacaccagcacattagaggaagctggaggagaaggatcggcttctgtaactacccatgtggattcagctaaaattggtccgcgcaaaatggtatttcccaacctgaacgacaccttggatgacgaattcggagatttccttgaacgctgaatttcaatgtaatgcttgggaaagaaagcccagttgcagatttgcaatagaaaaataatccctcggcacagaacatattgctgcactgatgatttgtttaacgcattgcaattatccaggcaaagcatctagatgggataattgtttgctgcaggtttcgagtcgagcccatcggtatgtggtttatagaaaactctgtggcagcctggggtttatcagcaagttggcatgttcttcctctgtggggtttgtatcccattcttgattgattgtagttaatgagaacattgtcgttgatgtagtcttctggtaaattattataattgtgttggcaaggtattaataatccattctttcttcgcttaatagcgatatatcttaccaaagaactagtttggtctcttaattgagtattcatatctatgtgcaaaaggctttcagttctgcatatgaatatatttccactggttcctctagaaatttatcagttatacaacatacctaccacttgtttctaggggatattgtaaggaatgatattcaccatatccggccttgacccgttggatgtagcagagaaggggtgccagagatttcactgcccattgtgttaggatggtgggacagatttatgtttaggtttcatttctttaaaaatgtggtttttcatttaaaatgtacagaggttttcagttccatccatgtttatttctgagcaagtttatcatacaagatatcagaatgatggataggagcaatgagagttgagtacgttgcgaaaggctctcatttgatcctttagttgaggatctagatccatatccatatgcaagaggtttcctattctgtatataaatatttcttaactaattcttctattaacttagcatttatacagtctacctttcacttgtttcccagggatattacaagggatgatattcatcacattgatcatggctacatggatgttttaaatcagagaaggggtatctggatgtaaataggcaacttcccatataaaatgtaaagaggtttcaagtttcttcagcaaaaaaaaaa

SEQ ID NO: 1814 - DNA, 1093 bp, Pinus radiata
caacatgccggcctttaattccatacttaaacacccaattcccctgcaaatcatcattcccctatgtcaagaactctgccggcttaaatttctgtgcaaaaatccatggataaggaagcctcttctatccctgagactatggtaactttggcaacactctcaggagcaagcagcaaatctgcatcaacagttaagagtggggtcaagaggattccaacgcagaacagggctgcctcttcgtcgccacaagagaggacattgaagctgaaaattccaacgtataaaggcgtgcgccgtcgtagttgggggaaatgggtgtctgaaatcaaggaacccaaaaagaaaagcaaagtctggctcggctccttcgatacccccgagatggccgctcgagcttacgacgtcgctgagttctacctgaagggcaagaagcaggcattgcttaattttccagagatgattgatcaccttttgcagccgctttctttgtctccgcacgacattcaggttgctgcggaagaagcagctgttgcgttctatttcagcgaacaagagaggaaaagccctagaaaccctcctgtaagtaatgagcccccctcctcgcatcaattattaacagtaattagctcaggctttgaggcaacagctgtcgagctaccaggggaagcggatactagtaattattcctcgtcggcttgtacaccaacagaaggtgttggtgagtctgaaagtacagtggtagaggatgattcattcaagtccttccatttatttaccaattgggcagaagctcctctgctctctccccgtcctctgtttatggttcacgaagaggaacacaatttggaggaaggatttctttggtctggtttttgaaagaaaaaactgtcagagtctataaaactacaggctctcctacatgcctagaccattaccaatttttggctgactgtatgccacttctagccatgcccctcttatctataaaatttgtgtaactcttaaaagattacagagaatgcacaaagtttggagagatgtacataaatatctttataaatattggaagaattattttgctctaaaaaaaaaa

SEQ ID NO: 1815 - DNA, 766 bp, Pinus radiata
ggtacgtaagcaggagagagatttattttcttgtgtttcagagtttttgcagtgcgtctaaatggcggtagaaaccatgcggatgtcgagggtgagactaggaagttgcgaggacgaatcccgggccgtcaaagaaacccatttcaggggcgtgcgaaaacggccgtgggggagattcgcagcggaaatcagagatccatggaagaagactcgagtgtggctgggcacattcgacactgccgaggaagccgcccgtgcttacgatactgccgccaggagattgcgcggccacaaagctaagaccaatttttctgtcaccgccgacgaccacaataacgctggtgcgcccgcactttcctggactcaggcgctgcatcctcagcagccggatctgaacgccgcggcttttgctttcgtatcaaacaagagacgtgaagtttcctctggaagcgaccggctcgagttcgaatctcccaacaattctctccacgctgcagcctctgagcaggcggcctcttcgtccccgcggagggccccgttcttgctggatcttaattttcctcccaccgctgatcaggaaaacgaaagcgcggccccgtggaattaatgggaacgaacttcttgagggttttagggttttctgtttcgtggtttctgtgcagtgtatttctacacaggatttcgtaacattttaaccagcatctgcaagatatatgtagagatttccagcttaaagtttgagattctcatttttccaaaaaaaaaa

SEQ ID NO: 1816 - DNA, 1914 bp, Pinus radiata
gcgccgatgccagattggatgtgcatgtgaatgaatgtgcctgtgatggggagaactggtggtagaagtgttctgcccaagaaagtggtggagtacaagactgtaattaccaagaaatttgaagaagagagtttggctcatggtggagagtttgaggggaaaaggattcccaggagagtgaaagttattagtactgaccctgatgctactgattcgtcctcagatgaagaaaatggtgatggcagtgggcagcccctgtattctggacgggtgaagcggcatatacaagaaattaatattgaattgccagatgggttgccttcgtgttctgagattgaaagagaagagtttcggtggatgaagaaatcaagcagaagcaacaggaggaggcagaggatccaggcaaagccttcttctgccagattgcctgcagaaaatgagatcgagagttcttccaagtatgctctgaggaatgtgcagaagagggataagaaatgcaacaagaaagatgatgtcttcgaatctgggaagaagttcaagggagttaggcagaggccatggggaaaatgggctgcagagatccggggcaatgataagggggaacgtttctggttaggaacatttgaaactgcagaagatgctgccagggcctatgataatgctgcccgaaaactcagaggccttgcggccgaaactaattttcctgacaccaccacttcagcgaccaggcacaagagagctcctcgcacatccaaggaatcgaaaccgagtccgataacaccgcctggctaccactgaattatctggagctgcagttagcaaggggcagagctcccccgattcagcagcacccgtcaagaaacgggccaggcgggatttcctctcctctgctgagccgagcattgcttctggctacgaggaggagtcatctggtgaggatggcatgctagtctcctcgccaacatcggttctccgatactgcctggaaaaggcccctgcaaagcacgagcccaatcacacagaaggtgataggaatgcaaaggtcggggacaatccaacggaaacagatggcaatgctgttccactgggcgatccgggtttctcattcctggatcttgacaattctgagctaaattgggactcagcgctggactatgatttgtttgaatctctccttgacgattcaggcccagcggattttctcattgcccatgcagagctccagcctggaaataatgaagatcaggaagccgtggacaagatgaagaatcccagcgaaacagagaacatcaacattgacaacagcaccaatcacagcagcaatcatgataccagaatggattcacaaattgaaagtttgttgctggatgattaccagtttacagatgagtttggcaacgtctctttcgtggatgacaccaacacagaagtggtgcctctgacgaatgaggatttcaatctctcattcgacggagatgattccctcgatatcttagatttcgacttcttcaacgacatggaatttgtgtaggtaacagaagcccaagcgctgtgtatgaagaaaaatcccaattccagggcaaattttggtagtattaagtaatagtatgagcatgtaatgaatgctcatggtggtgctctgcgccactcggcctgctatattattataacggtaataaccgtcgtagaataaataatggagagtgagagagcgagccgcagaatgaatccacaaattcaaagatggattgttctcgcctgccgcggctgctgaatctctagattcatcagatttgtttgttcacaacagagactccattggcgcagctgccagggattgatcctggggctgtgccaaggttgtccttttcatcaatacaaactgatacagataatatttattcaaaaaaaaaa

SEQ ID NO: 1817 - DNA, 2490 bp, Pinus radiata
gtcctgtctagcttcaaacattatttttacagcggaaatggtaatggcggccacagccgaagcttcgtgcggctcttgaatattccacgcgcattttatatatactcacagtgtatattgtttctcaaaccttcgggcgccccgagtttcgaatccgaatctacaaattagacccagaagttctcttacttgaatcaaggcatagtaaaaccctaatcttggaaatttagcgggtgcggaagctcggcagaacgagtgtcgcaaggtcttcagagaagagagattgaacgagtgccgcaagttcttcagagaagagagattgtgtgttatttactgcggggagaaccagccgctgtatgtcttcttcgtctctcaggaacaataccgttaaaggcaagcacgtagcaacggagccacaaaggagaagaaaagtgaggagcagaaaccatggctgcaccactgtagtagaaactttagccaagtggcaggagctgaacagccaggtggaaagctcaaaagatggcgcgaaaagactcaggaaagcccctgccaaagggtcaaagaaaggttgcatgaaaggaaagggtggtcctgataatggacgttgcaactatagaggagtcaggcagagaacgtggggaaaatgggttgcggaaatcagagaaccgaatcgtggaagtcgactgtggttgggtacgttctcttcagcggaggaggcagcacgtgcttatgatcaggctgcgagggttatgtatggatcttgtgcacgtttgaatcttcctgatatcagtgcctcgaaggagtcctcggtgacatctacttcaacaacccgtgtaacatgccaatctcaagaatgttcaacatctcagcaatatgaagtctctagcgagtggaaagattctaaaattcactccgctcttgatacggatatcggaggccaagttccctcatctcaatctcccggagttgatgctgtttatgaagctggagttgaagagaggaatgatgatagaatttcagagactgatcaaagatatgggtcagaaatgtgcttaggtgttgaggctgctcaatcagatcttccttccaaagttgagataagtgatgttgtaccagattctgcattagatcttcctgtaaagtcagagacaaatgaatgtacattgccccatatactggtacctaaagacgaaccacaagatgtagatgggaaaaatgcttttgatttgtcccaggctacattgcttagatttagagatgagccacaggcagatttgccttctgcagctgtcacaggagcattatcgaactctgaggtgcagccaatttccataaaaggtgaactcaatgagtctgcagagcctctcgactctttccaagatatccaattgcaggatctcgatgaaatgtttgatccagatgagctcttgaacatgatgagtggcaacgataacaagagtgaattatcggaagcagatacgtttaacacactttatttcagcagcccttggccacaggagcagttgcttgatggggtcttaccgagttgtgatccttcgtccagcccaactctgcaatacttgcagattcagagcccggacaataggctgctccaaaatcctattttggacgaaggtgaacaacttcacctggatgacagaaatttcaaagaccttggtcaattacaaccattcaatttagatagcttccaacaacccgaatatcatgttgtcaaacatgtcagattggatgatagacagcctctgcatcccaaggttctggatgatggtcatttcgcctcctttccatatccatacaacaatcaaggctaccagactgaagatgctagaacaaggcaagttttgtctccggagccgatgttgactggtggtttgcaggggatgcaggatgctaggatgtttcaagatatctttcctagttacaattagatggatcttgtgtatattggtacataatacttacaagtaggtggacattgtcaatatctattcatcgtatttgttgaggtaacctggccaacttgtggctaagatgaaccgtgttaccttgtgggtataaataatcatgtgatgtatattgttcaactttctccgtgccagaggacttatttcttattacttgtttaaagttgttctgccttttgttgcaaacggaattaggaatgtaggggaaagataaaaagacaaggtaattttttgattggggataatctctgtatggtccccatttttctctgttgaaattgtggaaaaaggtttccattgtacgtagtctctataacctgattgatttatcaaatactgtttcatatcacagttgagaagaggatctgtaacactaccatcagcacaacagctcagaagagagccattttacatacaaaagaaagcaacatggacagtttttgcttcctggctttgtatacgaatcaattatatataaatagttattttctcgtcaaaaaaaaaa

SEQ ID NO: 1818 - DNA, 1766 bp, Pinus radiata
acatgagatagattgaggtgccattgagaactttcggggggctattttaagcattggtggctggttccttgtacttattgttttgcagcagcaagatttgaagggattccgttgacaggtattaatgaagcgaatagcagcagatggtgaatcccaatcttgcttcgtctcaggctcaggatcgacgaagcccagggttaagcgcgtacgtagatgtgtgcccaaggataagtcgcaaaacgccacgccaggccgccggagctccgtttacagaggggtcactaggcacagatggactggtagatatgaagcacatctctgggataagaactgctggaatcagggacaaaataaaaagggcaggcaagtgtacctaggtgcatatgatgacgaggaggctgcagcacatacatatgacttggctgctcttaagtattggggaactgaaactatcctaaatttccctttaaacacctatgcgaaggagctcgaggaaatgcaaagtgtcagcaaggaagaatatttggcttccctgagaaggaggagcagtgggttttccagaggagtttcaaagtatcggggcgtagccaggcaccatcacaacgggcgctgggaagcacgcattggcagggttttaggcaacaagtacctctacctggggacattcagcacccaagaggaagcagccagagcttacgacatggcagccatcgaataccgaggtttgaatgctgtaacaaactttgacttgagccgctacatgtctcgtctccgtccagcgaaagatataataaatagcgatggagatgatgttgttgtttccaacggggacgactccggttcgagtctcctcgtccccgccggcgtgcccatcgaaacctcgaacaacaccgacgacgacaacatgtcttccttgctgctgttgcagcagccgcctcagctttcttggacgccgccccagctcgaagaaaaggaatcgtccagtgctgcaccagaagatcccactgacgacctggaccatctttttagtcagtcatcaaaattcaaggaaattatggaaattaggagtagtggccacggccacggccacaaggtgccgggagtcgaattagaagatttgcacaatgtggaaaccgctaatttcgcagaagatctggagatgttcttctctaactcgagcaatatgctgggctccgatgcggagttgtcacttaacgtggattctcccggctctgccatgaataataatatgttttgccaaccagatcacctgcaccttcaaatgcccttcgacatgcatgacctttgtagcggcgaattcctggatcttgaccaccacggccaacagcccgaacttgaatatcccttgatagatcccatctcttcttttcctaattttgcagtcaggacttgttcctgatcaattccacatcaccacaacaaaaagaagggagtttagttttagtcatatatatatgcaacaattaatatatatatatatatatatatgcgttgattcttctcttctttttcaatagaagaacacttatttggagccttgggtttgaagctgttaattaattttgatgcgctgtactctgcaaccctccaaatcggccggcgtgctgagagttgcagacaccagcttgtagttcagtgcaagttacccaaataacaaacaattgtaaggagctctactttatctcccgttttcctctgtcactcatatcaatgcgaaaatctttcactttgagttaaaaaaaaaa

SEQ ID NO: 1819 - DNA, 1082 bp, Pinus radiata
aaccgagcaatcaatgtagtgcagcgcaacaacttctgtcaagttcctccaactgtttttgatgacagatggcctgcgctccagctgttagtgattctcctgcagaaaacgcgtcgcctccatttcatcttttgctccgagtaaataaccccaccagaatgattaggctggacatgaagaagctcgcagctccatataatcccattgcctgtccttgctctgccctgatgatcaccatggatggtactggtaggaacttcgacaatggcgcggacgggattcgaaaccgcgacgctcggcctcgaacgtaccgaggcgttcgccgccggagctgggggaagtgggtgtccgagattcgcgagcctgggaagagaaagcgcatatggttgggatccttccaaacggcagagatggcggctcgagcttacgacgtggctgcgctcagcctgaagggaagatctgctttgcccaatttcccggattccgtccacacgctgccgcgcccctcttctctgaatcccagagatatccagctggcggctgcccaggcagccgccgaattaacgcagccgatggtctctaccgatatttcatcctggcaaccgcaagatcaaaatttatacgattctaataataatgtgaacaatgattcagtttctgcgtctgcttctgatcatgataatcatgaactttccagtgtttctatgacgtctcgcgatcgattctcgctgaacgaagaattactggccttgcattctcccaactgggtaatggatatggggtgcgctggttctgatttcctcgtatcgtcccctgccaactgcttcaacgagactgatgaatataattatgtacttgaacccaatgggctggaccaagagattttaccttcgagcatttttttctgaatgtctctgttaacatttctcataaatacgataggtatagcaggaatggcacacagtgatattctagttatgtatgggcacactgatattccagttatttttgagatttgtttataatattaatataagtatacatctattttaaatacagatttatttattttaaaaaaaaaa

SEQ ID NO: 1820 - DNA, 831 bp, Pinus radiata
aaaatgcagtccttgtttgcagaatcttcggagttcatgtgttcgttaaaggaggactggctttcagtcttcacgcaaaataacgactcagaggatcatgatctgcttatgttattgatgggaaataacgattcagggcatccgcaggaaatccttaagcaacaccctgcgcctgcggaaaagcgagaagaggaacacagagagtcggcagaggggaaacgttacagtaaacattacagaggtgtacgccgccggccatgggggaaattcgccgccgaaatcagggattcgagggtgaggagatggctggggacgttcgatacggagaaagaagccgccttggcatatgacatggcggctttcaaaatgaggggcaaccgcgcctcgttgaattttccggttgatgtcgtcaccgcagccttagcgcggggcgaacaaggttccaggttttgttcgccttatgatgagaaattccgccgccgactaaatgggaagaggtttaaagagacgaccgagccggaggagcagccgcctttgaaatggcggaggcataacttggacacagagcagattgagcaacgcgcggggtgggaggatgggcaaatctgcaacggccccgcatctgaagtgttggagctacaggacctgggcgctgactacctggagaaactgcttttattaagctgttcttcatcatcgccatcctctgccactgctgtacatgaagaagagtttgtctgttggtgatttccatgtccatatacttcttccctgttatggggcttttgctatgtattgtcattttctaatcctttcaccgtaaaaaaaaaa

SEQ ID NO: 1821 - DNA, 2906 bp, Pinus radiata
aaccacaacgaatgcgaagctatcaaagaaaagaaaactgagttattttttgcagactcgttgctcgtcagtttttcggcccgctgtcagctcgcccgctctcgctcacatttcctctctgtaacgtcgtccccatggcacgaatttgctgcttctgctcctgtaggttctcacagactgtttgtttttgttttcccgtctgatttctgctattattattatttttattttttttgccaattttcataggtaggtctgttcgctcgacctctatttttctgcatgtcgagagttcgattcctgtatagaattctgttttggtatttgaattaatccagatggtgctttatgttaggctgtaggaacctagaattagttggttttgaatgcagcaagggccgatttttttacccggaacccttgcttgcagatacagtggtccctagaacccattcctttctgtattacttgtcttcttcctgccattacgctctaaatatttgttgttgttgttctcctttgattgaattccctgtctgccttcctttccccttggtcatgtggtgagagcgggcagctgacagggcgagtttgattttaaggagtgttggatttaattgggctgatctaattgttttgtgggtaagtttttaatggcgtccaccagtggaagcatgcagggaatctatgtttcttcttccatgggaatggcctccaatagaaatgaggattggtgggacatcaaagcagtgaattcgcagcagagttctagcagattacttgaggcttcgacgcctaggcctagtaccaatcaagccccgtcatcatatccgaggcgtgaggacaggcctcagacagcagagtcacgggttcaagctggaaatctttctgagagggatgattcttcttcgagcctatttcataataatagttcttcttcctcttcttcttcacatttgatttcgttccccgcacattatccgcaggtaattagtagcatcagttcctccccttcatcttcaacactacatcaacatggttcagaatttttttatttgaatcaagttacacaggcgtatccaacccatcatagcacccaccaagcaatatcattcccacagcagcagatttgtttcaccaacttgcagagtcctgctcagcagcagcaattgcagtttcagtcagggtttcctttggtttccttcaataaccagcaaaatctgcagcagcagcagtaccagcagcaacttgtccggcagtggagcgatgctctgaatttgagtcccagaggacagctgatgaagcatggaaagcatcatgacaggaggggctttgctttggctcgtcctatgaagctttacagaggagtcaggcagaggcactggggtaaatgggttgcggagattcgcctcccacgaaaccggacccgcctctggcttggcaccttcgacacagcagaagatgcagctctagcatatgatcacgaggcttacaaattgagaggtgagaatgctcgtctcaacttccctcatctgtttttaaacaagggatctaccagccctaaagcttgttcagttgcggcagcccctgaggaaggcaatttgcagcaaaagtctgatggaggaagaaactctactacaagtagtacctctaccagcgctttgactgcaaatgctgcccaccaattaggctcccctgcagccgaaggtatttcagatacagcgcaggccaaatccatggatgttgaggtgaaaactgatctggacatatctgcatatgaagccaatacaaatttggctcctcctgcagaatctggatccgaggactttgtcaaaaatgaacctcaggaccttcaattccatacctggcctgcctcccctgaatataatatctggggtgatctggatgaaaactggttaaatagtgttcctgctttagaaacagatatgacatgggatgttctttttcacaatccaattgatagctatgtggaaggagtggactcagatcacaagcttgagactcaaggacaagcatccccggagcatcactctccgccgcagcagatgtatgtttggaaagactgcaaatagctggatcatggacacttgattctcggaggcaaagggttctgtaaatcactgtttgtttgtattgcatcgggtgtgtgctggatcactgctatgtatagaatagaaaactttaggtctcatctcctctttaggcttcctggttgattagcttagttcatttctaaatcattcccattgcgtcatttcgcatctctttctatatataattctcaggttgcaatttttgagtcaacctgtggatttttagtagacattgcagttctcttagacaaccaagacctctgtcctgaacaagtccctgcgatgtttccagtgccctttgcacatgaatcatggctggttttttaagccattttcatgtctggcctctctggtagagactggtataacctgcagcaatgcacatgcatttttgaactctagctctagtagttttattaatcttttagctatttccaatggtcttttcagtgatctggttaaccaccctggcaatttgtctcacaaagcagatgatttctacagtcctcattgccacgttagaaatttaatgcaaggacaataaatctgtaaagtttctagcttaagggtggcgaggatgggcttgaatttcaagtctcagtgtaaatgtagttagtagctgaagttggtttgcaactttgaagtcatacatatatggtagacagtttttagttctgcctaatattactactttgtgatgttgtatatgattcagtatgaaacatcatgcatgtatttcatgtattgatttgtgtaatagcaatctggtagaaattttcagtaaaaaaaaaa

SEQ ID NO: 1822 - DNA, 1132 bp, Pinus radiata
atttcatgggctcacttcactgactcccgccgtgaaatatcactattttggcttcagagtttctgcaaattgccaaatatggagaattttcccgaccaggaacctgacaatgccatttctctgccacacgaagatcgcggttcccgccaatttaagggaatccgacagcgaaaatgggggagctgggtatctgaaatccggatgcccagatccagaaagaagatctggctcggctcatacactacccctgagcaggctgcccgtcccgcagtgagagggcgcaatgccgatttcaacttttctgtgcccgacattccgactgcgtctcccctttcccgtgagcaaattcagcatgccgccgccgaatatgccttgggccaagccccttccagttttccctctttcgcagggcagttgtctataatgagattttttggaagtttttctggtgggtttttctggtcaaaatccggtagtaatttattggaatcccaagtttgatagctagtttctagtttctgcacaatcaaaacgtcccaggggtttttcagggtgctgaatccaaatatacaattaaaaaaccattttaacagcaacaaatcaagatttacctcaatttcttctgccgaattctgtcacgaaaatctccaaaaaatcacattatagacaactccctttcacaggtccccggcagtcgtcttcggtttcggaaatgaacttggcgcgagacaaccttcagatatgtgaggagagggaggacttggcgctgtggttgtcgatgctggcgggatctgacggcgccgggattccaaatttggatatattcccgtcaactgacgacgtgtcggcgttggagttccttcccactgaggaggagcaggagaggtacagatggacagatctctggaatttccgacacgtttgacctcgtgagatgaggaagcagacaaatccggcgtttcggattcacgtgaggtacacgtggactcagttggaatgtgggaccacttcctggcccaggcaaaacgttcttgccacctggcatgagcagtgtcggacgacaactatccaaccttcaataaatgtaccatatatttccaggaaaagtaataaataaaatttgtagacctca

SEQ ID NO: 1823 - DNA, 814 bp, Pinus radiata
cagtatctgtctcctggcaaatcagctcctttttggctttgccaagatatggcaataacctctcaacaacatcatatgaatgctcttccatataacgaacgcagtgaaaaacgccccaaatttaagggaatccgaatgcgaaaatgggggagttgggggtccgaaatccggatgcccaaaaccagaacgaagatatggctcggttcctacgaaacggcagagcaagccgcccgtgcttacgatgccgccttatattgcttgagaggccccaacgccaaattcaactttccggacactgtaccttcaattccgtcggcgttttctctttcacgccaccagattcagctcgccgccgctagatatgcccgggacgaactgccttccacttcgccctctcaacacagtaataatatcaataatggcgtctccctcgcctccccgtcgcgatcgtgtagggtttcagaaacggagttgtggagcaacagcgagcagatttcggaggagcagaatttctgggcgtctctgttggacagcagtgagtgcctcaactaccagaacttcccgtccattgacgacacctccacgttggacttcattccgacttggcaggatgagcaagatcgttacatctcgctcgacttgtggaacttctaagagtttagacaaacgagtgaaatatacgctaacacgtggcctacacaattttcctgtaactgtcacttttcagagggatggtttggcaatatattagtgatccatctttccatctcaacgactttttatttacattacaagttagcaagtaaaaaaaaaa

SEQ ID NO: 1824 - DNA, 3460 bp, Pinus radiata
gttacagcgagggtttgatgacgacgaagaagaagcttctctgaagggcaaggtgcggtggggactagattcgatagcggctctgggtttaaagttctgaattaaacgggctttggctaaaaagtaaaaaacggttggaatttgagcaggaggagctgatagagtgttattatcgggacggatgaaataattgaagccaaaggggcttatgtgtgtgttttgcggacttctgcgagtaaggggaaatggaattattggagtgaagtaggtgttcttggagaaatatgcgggcagctcataataacagcaataatagtgagaaatcttgcgtgttgagatctctctgagcttcgcttttcagaatgaggaccggcttctcccagcagcatcgggaaggggaaaagaggagtctcaattcagagctatggcatgcatgtgctgggccacttgtgtccctacctgctgttgggagccgtgttgtatattttcctcaaggtcacagtgagcaggtggctgcctcaacaaacaaggaggttgatgctcacattcctaactatccaaatcttccaccacaattaatctgccagctacacaatgttactctgcaggcagatgtggagacagatgaagtatatgctcaaatgacattacagcccttaaacactcaagagcaaaaggagtcttatctagctcctgatattggcacgcaaagcagacagccaactaattacttctgtaaaacgctaacagcaagtgacaccagcactcatggtggattctcaattccacgccgtgctgctgagaaagtgtttccaccactggatttcactcagcagcctcctgttcaagagcttgttgctagggatcttcatgacaatgagtggaaatttcggcatatttatcggggtcagcccaagcggcatctgctgacaacaggatggagtgtatttgttagtgcaaagagactcagtgctggtgatgctgtgctttttattaggaatgagaaaggacagttattgctgggaatcaggcgagcaaaccgatcccaaacggttatgccatcatcagtgctgtccagtgatagcatgcacataggtgttcttgcggctgcagctcatgctgcttcaacaaactgccgcttcactattttctacaatccaagggcaagtccatcagaatttgtcataccattgtctaagtatgaaaaggcagtttatcacacacgagtttcaattggaatgcgcttccggatgctgtttgagacagaagaatcaactgtacgaaggtacatgggtacaattactggcataggtgacttggatcctgctcgctggccaaattcacaatggcgttcaattaaggttggttgggatgaatcaacggcaggtgagaggcagccacgagtatctttgtgggagattgaacctttgaccacgtttctgatgtaccccccaccctatcctctaggactaaaacgatcatggccacaactacagggaataacttctctttatggcagtgatgatggcagtttcaggaggccattcatgtcagagaggggggataatggggagcaaggccttcagaccttgaattttcaaacaataagtatggatccgtggatgcagatgcagcaaagatttgaaccttctttatcagggatccagtccactgcataccatggaatgcctacaactgtcttgcagcagacagggaatcttaatcaatcgaaacagctgaagtttcagcagcagcagcctgtacagtctgaacaacttcagtgcaggccgcaggtacaatcacagaggaatgttattgagcaacaacaacagcatcagcttcagcagcaagtttttaacttagagcaacatcaaccacaaaatcatcttttgcaacagcaattacagcagcagacattgcagcaacaagcagtgcatcagcagctgcagaacgcaattaatgaacagcagcagtcatcatttcagcatcaacaaaacaagcaacaggcatttcaagttccaaatgttgtcaattcattcacacagctctcaacatcccaatctcagtctccattaagtgatatttcttctgtgacctcacggccagtctttacaaatactggtgccaccattgcctcacctaagagctcatctagtgcatctcctttacaaagcatcttagactcattgacttcagagggagcttctacctatttaagtgtgccccgaccaagtcaatctgttgtgcagcaaccagctgaaacttggtcttgcgttactcaggatcagcaagttgctgcaccatggttttcttccaaaagaatgtcaactaatcagattccttgtcttccatctggtcagactgaagcctctctttctactggtagtcatcgtatcctgtcccaaactgaacctaaaagtcagactaatgttccagcccaatcaatgccactgcctcaatttcctttaagagattgtcctacagaacaggaaggagttcagtctgattcccagagcaatcttctttttggtgttaatatagataacccaactttggctatttctgatacagtttctagtgcaaggaatgtgggcaatggtgcttatgtagccagttcattttctgttacggacttactgaatgtgcctccttgtgctcctgtctctgggttctctatgaattctaacatgggtgtgtctggaggtctagatgaaagtgggttttcacagcctccaccaaattttgcaaagatgaatgctcccacgagaacattcactaaggtttacaagctaggttctgttgggaggtcagtggatgtaacacgtttcaggggctatccagatctgcgtgccgagcttgaccgtatgtttggtctagaaggccagctggagaacccaagatcaagctggcagcttgtatttgttgacaaggagaaggatgttcttctccttggggatgatccttgggaggagtttgtcaataatgttcgatttattaagatactctctcctccagaagtgcagcagatgagtcaggaagatatggagttttggagttccattccaactcagcagcagacaagcagtagttcagaagactgtgtagctagaaattcttctcgcaacatcagttcagttctcacatcgactggatcactggagtattaagtgtagttcaattgtactatatcaccagttgtgttgtgtctttaaaggggggtcgtaaaaaatgagatgtacttcagttcataactcttaggtatgccccataatatgttcgtccaggatatctaaatgatgaagtggtatttagcgtcattttctttgattgaaagttgataacttgctgcattgttctagaactgtatttgaaaaatattgccttgtatctctgtttatactctcgttttatcttttgttgcaagaatgaataatgttttactactgaaataaaaaaaaaa

SEQ ID NO: 1825 - DNA, 3460 bp, Pinus radiata; identical to SEQ ID NO: 1824

SEQ ID NO: 1826 - DNA, 4191 bp, Pinus radiata
tttcttctttccttcgtcttgctgcccatccggcttcacgcaatctttttgccaaaagcctggaatttatgcactccagtccgccattgcagctgctgctgtggatttgctgatgataataatagggacactctgctggaatcctcaaatgcagacgaagcgcaggaagaaatatgcgtgcttgcatttgcttcaatgaagaatattttctttttcttcgaactgccgtcggatcgagtgtcttggagccttacgatgaacagaacgcatgtttcttgcaatttgctgccgaatatgctattccatgccagcggcagaggctataaaaaattgtgaagaaaaaacttcaaaccctgacggtctcgagatcttgatgacctaccgagcatagcttctttgcttgaaagcttcaatagttgttaggcttcatttatgtatgtttttttgttggtttctgaaagaaagactgtgctgacagtgtttgcgaggctgtttgagtctcgttttttggagctttagggtttttgaatacgggatccgtcatggaggaggccgcggaacgggatttgctttagctacaacgagatttttgcagaatgcgttgctggaaacatagccgtgacgagaatacagttggggacgcctcggtgtcctttcttagccgttaacaaataactagaacggttctggacgtcgtaggtttgtatcttgcaaggaaacggggacagagccttgacattgtttgaacagggatctttttggtcgaaaagggaacgaagaaacgggaaatcggcatgcaagactgtgttgtcgactggaaatttagaaagaaaaacagagggctctactgtttctggcggagaagtagagacatttgctggataaaaaagggttactgtacataaatatctgacaaatctgcgctaggggaagtatcttgtggtggaaaagctgaagtcaggggacacttggcggaatattgggaaatcaaagctcaggcgttgttcattttgctatattttcgtcccaagcttaaggccaaatgaggctctcgtcctcgggcttcggtcagcagcctccagaaggggaaaggagatgccttaattcagagctttggcatgcctgtgctggaccgcttgtgtccttacctgctggtgggagcaaggttgtttattttccacagggtcacagtgagcaggtagctgcttcaacaaacaaggaggttgatgctcatatacctaattatccgaatcttccagctcaattgatctgccaacttcacaatgttacaatgcatgcagatgtggaaacggatgaagtatatgctcaaatgacattgcaaccacttaatgctcaagagcaaaaggattgttatcttggttctgacctcggcacgccaagcaagcaacctactaattacttttgtaaaacgttgactgcaagtgacactagcacccatggcgggttttccgtgccacgtcgtgcagcggaaaaagtttttcctccactggatttcactcagcagccacctgcccaggagctgactgccagggatcttcatgacaatgaatggaaatttcggcatatttttcggggtcagcctaagaggcatctgctcacaacaggatggagtgtttttgtcagtgcgaagagacttgcagctggtgattctgtgctctttatttggaatgagaaaggacaactgttgttgggaattagacgagcaaacaggccacaggctgtaatgccctcattggtactctcgagtgatagcatgcatatagggctccttgctgcggctgctcaatctgctgctacaaatagtcgatttactattttctataatccaagggcaagtccatctgaatttgtcatacctctggcaaagtatgttaaagcagtttatcatactcgtgtttctataggaatgcgttttagaatgctatttgagacagaagagtcgagtgttcgcagatatatgggcaccataactggcataagtgacttggatcaggttcgatggccaaattcacattggcgttctgttaaggttggttgggacgagtcgactgctggtgaaagacaaccacgtgtatcgctctgggagattgaacctttgacgacatttccaatgtattcgtcaccctaccctctcagactgaaacgtccttggccacagggaatatcatcacttcatggtattaaggaggatgatggtggcataaatacacctttcatgtggatgagggatgatggtggggatcggagtgttcaggctttgaatttccaaggaatgggtatgaatcattggatgcaacagagatttgattccagtttgctagggatgcaaccagatgtataccaagcaatggctgctgcagccttacaggaaatgagaagtgttgatccatccaaacagctcttgcagtttcaacagcagcatcatttgcaacctcaacagtttcaatgtaggtcgagtccacagttacagaggcatatttttcagcaacaacaggcgccacaacaaaatattcttcagcagcaagctcagaacttacaggaacaatccccacaaaatcatcttcttcagcatcagttacagcaaaactcatctcagcatcatcttttacagcaacaactgcagcattgttttaatgatcagcagcaaccattgtctgagcaacaacaatgccaacaaccatttcaagttccaaatgttggtggtgccttgtcccaaatcccttcatcccaatctcagccagcaataacattgccatcatccatgtgtccaaaaccattatttgcagattcgaatggaaatctttcttcagctatgacgattccaactatatctactcttcaaaatatattaggctcttcgtctggaggagaaaattctaactatttgaacttgcccagcactagctctgtagtccatcagcctgtgggaatgttaacaggacatggtattccccgtgattgccaaatttcctctacttcatgggttcaaaagcttttatcaaataatttggtcccctgtcatccaggtggacaagttgaacatcttccttcaggaggtcaatgtgttgtgccccaaacagaatctcttggccagtctaatattccatcatcatccatgccaatgtcattaccacaatttgcatcaagagaatgccctccggagcaggaaggaattcactccgattctcagagccaccttctttttggtgtcaacatagattcctcgtctttgattgttcctaatacagtatcaaacatgaggagtattggcagcagtactgatgcagtcatgcaatttggtgtttctaattatttgaatgcacctccttgtgcttccggttccaatatttcattgaattcagacatcagtgcttctgcatgtttagatgaaagtggacttttaccacccgctgaaaatttgggacagatgaatgcacctacaagaaccttcataaaggtttataagcaagggtcagtcgggagatcgctagatatctcacgcttcagcagttatcccgagctgcgcagtgaacttgcccgcatgtttggcctagaagtaggccagcttgaggaccctctaagatcaggctggcagcttgtatttgtcgacaaggagaaggatgcccttctccttggggatgatccttgggaggagttcgttaataatgtctggtttattaaaatactctctcctccagaggtgcagcaaatgactcaggaaggtttggaactattgagctcatttccaacacaacggcaagcaagcagtagttcagaggattatgtcactaggcaggactctcgtaatttaagttctgcaattacatctgttggatcgctggattactaggtatcatgcgcccactgtgtaatataattataaggtacacacttgttcagtttgtgccttggtaagaactgacacaagtattttctaatattgcatactctgggcccctggggtattgagtattaattactgtatcataaaactagtttgcctttatgattcgataggggatgctacagtgtgtttgattacttgttaacaattcggtgtgattaaacaactaatatgctttccccagtggtgtgttttgcaatgtacctgattttcataccaggatgctttaagtacatatatatcagccttcactttgaaaaaaaaaa

SEQ ID NO: 1827 - DNA, 3836 bp, Pinus radiata
ctggtttcttttatgaacgagagcagaaaatggaagtgtcacagaaaggtcatagaagcgcttcttgtgtgagcgccgtcattgtgatgggcatggtggagcagcagagcttgcagtagtggcagcctggcaggggcttttaaggttgttgtcaattggcccatctggcgaaggggaaatcacacaacacatactctttcatggtaaactgaaacgaggcacgttctttgaagtggtgagcctcacgcgcgcactctctgggcttggcggcagcggttcgactcactcgccactctaacctccgggaaaagcaccacaaagcatccacctttataataataatcattgtggactggtttatactgacatatacagagacacagggcatttgtgaaggaattcaacacattaggtgctgtgcttttaggatacaccaaaatgctggagcgagcatcctattccttacttcttgttgtctacacagccggagtgaggcagtgaaagccgtttagtgggaattagaaactttcagaaacctcctcactcaagaggatatctggaggcgattataggcgtagagtaggttaatgctttgacataattaagcaggcaagtagggaattaaggaaggaaatctgaggagtagattctcttgaaggatttcgtgtcttgtcttgttgggaagaaattgagagtctatacacacaatgaggctgtcctcctcgggcttctctcagcagtctcaagaaggggaaaggagaagtcttaattcagagctgtggcatgcctgtgccgggccccttgtatctctacctgcaattgggagccgtgtggtctattttcctcaaggtcacagtgagcaggtggctgcctctacaaacaaggaagtggatgctcatatacctaattatccaaaccttcctcctcaactaatctgccaacttcacaatgtcacaatgcatgccgatgttgagacagatgaagtatatgctcaaatgacattgcagccattcaacctgcaagaacaaagggaaccgtctagtctagttcctgaacttggggcacccagcaagcaaccaactaattacttctgtaaaacactaactgcaagtgacactagcactcatggtggattttcagttccacgtcgtgcggccgagaaagtgtttcctccacttgattttactcaacagcctcctgttcaggagctcattgcaagagatctgcatgataatgaatggaagtttcggcatatctataggggtcagcctaagagacatttgttgacaacaggatggagtgtgtttgtaagtgctaagagacttgttgctggtgactcagtcctgttcattagaaatgagaatggaaagctattgttgggcattagaagagcgaacagatcacaaacagttatgccatcattggttctctctagtgatagcatgcacattggagttcttgctgctgcagctcatgctactgctacaaacagtcgattcactgttttttacaatccaagggcaagtccatctgaatttgttataccacttgccaagtatgaaaaagcaatttatcatacacgaatttcagcagggatgcggtttcgcatgttatttgagacggaagagtccagtgtgcgtaggtacatgggtactattactggctttggtgacttggatccagcacgctggccaaattctcaatggcgttctgtgaaggttggttgggatgaatctactgcaggtgaaagacaaccccgagtatctttgtgggagattgagcctttgaccacattcttgatgtacccaccaccctatcccttgaggttaaagcgcccatggccacaacttcaaggaatgtcttctattcctggtattaatgatgacgattgcaagatgatgaaaagtatcatgtggactggaggagataatggggagcaacatcttcagggcttgaactttcaagggctaggcatggatccttggatgcagatgcaggatagatttgattcttctgtggcaggagtccaaccagatatgtacaagtcaatggctgcagcagcattgcaggaaatcaggagtgttgattcttcaaagcagcttctgcaattgcaaccacagcagcctgttcagtcacaacaacttcattgtgtgccacaaccactcgtacacaggcaaattttccagcatcaacagtatccacaacatattcttcaacagcgagcacagaacttacaacagcaacagcagtcgcaacagaacatacatcagcagcaagctcaaagtacgcagcaacaacaaccacatcatcatatacttcagcagcaagctctaaatgtgttgccacaacaaacaccgcagcatgtcacgcaacatgctcagaatgtgcagcaacaaatacagcaacagtcatcacagcatcaagtattacagcaattgcaacagtcttacgttgaacagaagcagagcacttctcagcaagtacaatgccagcagcagacatttaaaatatcacacgttgctggtgctttatcacagaccccagtgtctctgtcagattcgccaataagtttaccatctaatgtgtcttcacaaccagtcttggctgattctaatgcaaatattgcttcacatgcatctttgtccactgcatgccctcttcaaagcattttgcattcactggcatcagatgaaagttctcactacccaaacatgcagagggctattcaacctcgtatgccacaaccatccagaaatttaacaggacctctctcgcaggataggcaagctgcttcagcttcatgccattcatcaagaagagtatcaaataatcaaatggaatcttgtccaccagctggacaagttgaatcccctcttccttctgggggtcagagtattgtgtctcaaacacaacccacaggtttgtctggaggcttggatgaaaatggtttattgcaatgcacaccaagcttgtcacaactgaacccacctacaagaacctttacaaaggtttacaagctaggatccattggaagatcagtagatgtcacacggttcagtggctaccatgagctgcgcagtgaattggcatgcatgtttggtttagaaggtcagcttgaggacccttgcagatcaggctggcagcttgtatttattgataaggagaatgatgtgcttctcctgggggacgatccttgggaggaatttgtgaatagtgttaggtctatccggatactctctcctccggaggtactgcaaatgactcaggaaggtatggaatggttgaactcaatttcagtacagcagcaaacaagcagtagttcagaggagtgcgtcactggacaagattcccgcaacatcagttcttgcatcacatctgatcggtctcttgattactaagaatgggacgaatgtccactgttaagcaatttttttctatgtggtgaagggacgatgagctgtatgtttcagtgaccacagtattaagtgttgttctatagctctttaattcaaattgaacttccgagtttgaatttagtgactggaaaacatagcactgtatttttccttttttctctgatcaaagagaagtaagaacttagatgcttggttgcatggttcaagatagtgactaatacactactttacggcctgtttcttttattgtacctttctttttggttatctccaatagtttcagacgggggtactgttttatttttagtactgtaacagtacataactgttacatcccaaaatcccactgctagcagagccacactgtaatgaggagattgttaatagcagacctgttctggtattgctctaaaaaaaaaa

SEQ ID NO: 1828 - DNA, 3466 bp, Pinus radiata
ggtcattccaatggtaaaagatccccggtgtaattgtctgttatcgcgcagggaagcatgagtgcctggtcatttgggaaccacgcttctgctacctctgtgctgcttgtacttgggctaatgaaccatccttaatgcctaccacatatccattgcttcttctttcatttgtgtctttacatggccaggatttctctgagcagctggtgttgaagtgggttgagcggatttgttctgtttgaattgtttttgtcggtcctgtatttgggttttcatggaaattgatctaaacagtccagatgaatacagcaatggaagactcaatagtagcgaggagttggcattgagcaaaagctcaatatgcatggagctatggcatgcctgtgcaggacctctgatatcactgccaaggaaggggactttggtggtgtattttcctcagggtcacctggagcaggcgtccacctccctcaagcaacaacaaatgcgcccatatgaactcccacctcagatcttctgtcgtgtgctgaatgtgaatctccatgctgaccaggagacagacgaggtgtatgctcaggtcacattggtccctgaacccgagccattggaagacgctgtaggagacaaagaggaagaggatgaagatgtgctcaacaaaccgactccacatatgttctgtaagacactgacagcttcagacaccagcacacatggtggattttcagttcctcgaagagctgcagaagattgctttcctcccttggactatacccaacagcggccttcacaggagcttctggcaaaggacttgcatggagttgaatggaaatttcggcacatttacaggggtcaaccaagaaggcacttgcttacaactggatggagtgtttttgtcagtcacaaaggtcttgtatctggggatgctgtactctttttgaggggtgaaaatggagagttaagattagggattcgcagagctaccagacagaaaagtggtattctatcttcagttctttctaaccagaatgcccatctcagtgtgcttgctgctgcagctagtgctgttgccacaaagagcatgtttcatgttttctacaatccaaggacaagtccagcagagttcattataccttatcagaaatatgtgaaaagttgcaagcaaccattgtctattggaatgcgcttcaaaatgagatttgaaacagaggataccgctgagagaaggtacactggcatgataactgcaataggtgatgcagatcctgctagatggcctggttcaaaatggaggttcttgaaggttgaatgggatgaacatgcagcaaatgaacagcaggaaagagtttctgcatgggaaattgagccatctattgcgggtgctggattgaatgtttcatctggtacaagaacaaagagacttcggacaactcttttgtctacaccagtagatgttgccatccctgatgggagtaggttatcagactttgaagaatccgtaagattccaaaaggtcttgcaaggtcaagaaaatatgtcttttaaagctccttcaagaaatgatggagttggttttatgaaatgtccaatactggaacgcaagggttgcaatgctgtagctgaaggctttgaaacagcaagaaccgagaatgcgatctggtcttcactagaaagatccgacatttcaagtaggttattagactttggagaatctataagattccaaaaggtcttgcaaggtcaagaaatcctgccttcaaaggcatctcttacaagtgctggagttgatttgatgaaatttcaacattgggactgtaagggctatcatgctgaaggctccgaaggagcaatgcatggacataaaagttggccttcattaggaaggcctaacgttgctcctttctcagatgtattgagtaataaaggcaagtttgggaatgcatatggatctgacaaaataagatcagtggagtattcttgtgaacaattctcaaatacaaacacgccacatttgaaagtttttactaagccacacagtggaggtaatcatgcaacatgcactgtgaactctcaaaatctagcaacaattccaagggcctcaccactgtcttctatttttggttccagaactagaaatgattcagaattatgtgtacaaggaacatatccaatgtgcagaatgaatgtttttcagaaaaatgatttatatggggattattcccagacatttaaccgtgatctttcagcacagtttgatattcccaaaatggcagttgggtggcaggcttcgtcagtctcgcactgtgattctgataatacgcaacctgccggatacacagctggcttatcctcaagtgagccttcaaagaagcaagaaaagttgatagaagtatttctgaaacaacatcagcttcctataggattccattccacagagactgatcgaggtgaaatccaaggaaagcaaagttgcaaacttttcggattctctttaattgaggaacctgcctgtatggatgatgtgattagcagcagcatacctcatggtgatattacccaagaaggtttgcctgcaatatatgggcatgggacagtccactcatctatttctcaaaatcaggataacctactgaagtcctctgctgatcgttctggtccacctgaagcactgaagggttcggcacaacaaaagacattccaagctgtttcgggactttccactttagttcaaactccagggcgtagacgtacaaaagttcataaacaagggaatgttgtgggaagagcagttgatctctcaaaactcgatggttatgatcaactgatatgtgaattggagcgcctatttgacatggaaggtcttctgaatgatcccaagaagggatggcaagtgctttacacagataatgaagatgacatgatgcttgtcggtgatgatccttggcaggagttttgtaacattgcttgcaaaattctgatatacactcatgatgaggttcagaaaatgacacccagcatgtttagcgacgatgctaacagttccgaggaacaaccatctacagttgaggtgtccaagtcatcaattgacaaccaggattcttcttcaccactgatgacaggaaatcaatgaaggttcctcattactcctgggacatggaaacatgcttcaatatcaattgctgcgacgatatgtgatatactggctacagatttaaatatatttttattagtgtattttcccctgattgatgagacaatgtgtggaatgattgatgagacaatgtgtggaatataggttagggataattttattgttattattattgacgtctccttattattattgttattattattttcttgatcctatacttttcctcagggaatttactgtagtgatcccatggctatcgtatgctggcattagacctaacggagcagtattagctgacttcaaacaaaaaaaaaa

SEQ ID NO: 1829 - DNA, 3466 bp, Pinus radiata; identical to SEQ ID NO: 1828

SEQ ID NO: 1830 - DNA, 3314 bp, Pinus radiata
atttgagcaggaggagctgatagagtgttattatcgggacggatgaaataattgaagccaaaggggcttatgtgtgtgttttgcggacttctgcgagtaaggggaaatggaattattggagtgaagtaggtgttcttggagaaatatgcgggcagctcataataacagcaataatagtgagaaatcttgcgtgttgagatctctctgagcttcgcttttcagaatgaggaccggcttctcccagcagcatcgggaaggggaaaagaggagtctcaattcagagctatggcatgcatgtgctgggccacttgtgtccctacctgctgttgggagccgtgttgtatattttcctcaaggtcacagtgagcaggtggctgcctcaacaaacaaggaggttgatgctcacattcctaactatccaaatcttccaccacaattaatctgccagctacacaatgttactctgcaggcagatgtggagacagatgaagtatatgctcaaatgacattacagcccttaaacactcaagagcaaaaggagtcttatctagctcctgatattggcacgcaaagcagacagccaactaattacttctgtaaaacgctaacagcaagtgacaccagcactcatggtggattctcaattccacgccgtgctgctgagaaagtgtttccaccactggatttcactcagcagcctcctgttcaagagcttgttgctagggatcttcatgacaatgagtggaaatttcggcatatttatcggggtcagcccaagcggcatctgctgacaacaggatggagtgtatttgttagtgcaaagagactcagtgctggtgatgctgtgctttttattaggaatgagaaaggacagttattgctgggaatcaggcgagcaaaccgatcccaaacggttatgccatcatcagtgctgtccagtgatagcatgcacataggtgttcttgcggctgcagctcatgctgcttcaacaaactgccgcttcactattttctacaatccaagggcaagtccatcagaatttgtcataccattgtctaagtatgaaaaggcagtttatcacacacgagtttcaattggaatgcgcttccggatgctgtttgagacagaagaatcaactgtacgaaggtacatgggtacaattactggcataggtgacttggatcctgctcgctggccaaattcacaatggcgttcaattaaggttggttgggatgaatcaacggcaggtgagaggcagccacgagtatctttgtgggagattgaacctttgaccacgtttctgatgtaccccccaccctatcctctaggactaaaacgatcatggccacaactacagggaataacttctctttatggcagtgatgatggcagtttcaggaggccattcatgtcagagaggggggataatggggagcaaggccttcagaccttgaattttcaaacaataagtatggatccgtggatgcagatgcagcaaagatttgaaccttctttatcagggatccagtccactgcataccatggaatgcctacaactgtcttgcagcagacagggaatcttaatcaatcgaaacagctgaagtttcagcagcagcagcctgtacagtctgaacaacttcagtgcaggccgcaggtacaatcacagaggaatgttattgagcaacaacaacagcatcagcttcagcagcaagtttttaacttagagcaacatcaaccacaaaatcatcttttgcaacagcaattacagcagcagacattgcagcaacaagcagtgcatcagcagctgcagaacgcaattaatgaacagcagcagtcatcatttcagcatcaacaaaacaagcaacaggcatttcaagttccaaatgttgtcaattcattcacacagctctcaacatcccaatctcagtctccattaagtgatatttcttctgtgacctcacggccagtctttacaaatactggtgccaccattgcctcacctaagagctcatctagtgcatctcctttacaaagcatcttagactcattgacttcagagggagcttctacctatttaagtgtgccccgaccaagtcaatctgttgtgcagcaaccagctgaaacttggtcttgcgttactcaggatcagcaagttgctgcaccatggttttcttccaaaagaatgtcaactaatcagattccttgtcttccatctggtcagactgaagcctctctttctactggtagtcatcgtatcctgtcccaaactgaacctaaaagtcagactaatgttccagcccaatcaatgccactgcctcaatttcctttaagagattgtcctacagaacaggaaggagttcagtctgattcccagagcaatcttctttttggtgttaatatagataacccaactttggctatttctgatacagtttctagtgcaaggaatgtgggcaatggtgcttatgtagccagttcattttctgttacggacttactgaatgtgcctccttgtgctcctgtctctgggttctctatgaattctaacatgggtgtgtctggaggtctagatgaaagtgggttttcacagcctccaccaaattttgcaaagatgaatgctcccacgagaacattcactaaggtttacaagctaggttctgttgggaggtcagtggatgtaacacgtttcaggggctatccagatctgcgtgccgagcttgaccgtatgtttggtctagaaggccagctggagaacccaagatcaagctggcagcttgtatttgttgacaaggagaaggatgttcttctccttggggatgatccttgggaggagtttgtcaataatgttcgatttattaagatactctctcctccagaagtgcagcagatgagtcaggaagatatggagttttggagttccattccaactcagcagcagacaagcagtagttcagaagactgtgtagctagaaattcttctcgcaacatcagttcagttctcacatcgactggatcactggagtattaagtgtagttcaattgtactatatcaccagttgtgttgtgtctttaaaggggggtcgtaaaaaatgagatgtacttcagttcataactcttaggtatgccccataatatgttcgtccaggatatctaaatgatgaagtggtatttagcgtcattttctttgattgaaagttgataacttgctgcattgttctagaactgtatttgaaaaatattgccttgtatctctgtttatactctcgttttatcttttgttgcaagaatgaataatgttttactactgaaataac

SEQ ID NO: 1831 - DNA, 3305 bp, Pinus radiata
ttttttttttgttccaacaggccctttgtgtgaagacccaaacggggttcgtgcattctgctcttgcgaagggcactctcagggtcctttaggggaacattggttgtctttttataggatcttcgacagcttcaggaatttctctggcaggctgcctcataatagtcctgcgggtaactattcgacattagccaatgaggttcccggagctcctcagtctcttatgccttcccaaagtacaaattcaacgcagaattctttctctggagggattgggactgatgccagtgaatctcttctgtatgaagagctatggcatgcttgtgctggtccacttgttactatgcctcgtgtaggggagagagctttttactttcctcaaggccatatagagcaggttgaagcatcaacaaaccaaggggttgatcagcatatgccactgtataatctaccttctaagattctttgtcgtgtgatcaatgtgcaatttcgggcagaacctgagacagatgaagtatttgcgcagatcactttattgccagagggagatcaaaatgagtcatctcatgactcgggggcagctcctcctcagcctcgtaagagcaatgttcattcattttgcaaaactcttactgcttctgatactagcactcatggaggattttctgttttacgaaggcatgctgatgaatgtcttccacctctggacatgagtcagcaacctccttcgcaagagctggtagccagagatttgcatggaatggaatggcgattccgccatatatttagaggccaaccacggaggcatttgctaaccactgggtggagtgtttttgtcagctcaaagagactggtagcaggagatgctttcatattcttgaggggtgaaagtggagaactgcgtgttggagttaggcgtgctatgcgtcagcagactaacatgccatcatcggttttatctagtcacagcatgcatcttggtgtcattgcgactgcatcacatgctgtttcaactcggactatttttaccgtttattacaaacctaggacaagtccgtcagagtttatcattccttatgataaatacatggaggcagtgaatagcagtctctctgttggaatgaggttcaagatgcgttttgaaggagaagagtctcctgaacggaggtttactggtacaattattggcatgggtgaggttgataatgtgagatggccagaatcaaagtggagatcacttaaggtccagtgggatgaaacatcagtggtcccgcgaccagagagggtttcaccatgggaaattgagacgtttgtagcttcatctgcagcacttaatcctttgccagcaccaaggactaagaagcctcggcccaatttggtgtcctcatctcaggaattaatgatacatggatcgggcaaaacagcaacagattcttcacaggtacacagattgccaagggtcttgcaaggtcaagaaatgaggacctttggaggatccttgggtgacagtgaggtggagagttctcaaaagccactgatgtggggatccagtgtggaccaaaagcaagatagtgttggttctcgaggaaggttggcttcagagtattgggtgtctcagtgcaggcaggacacggtctattcagactcctattctgtaattcagggtgctagagatacgcaacaactatgcggcccaacagcatgtcaaaacatggaaatattccaacgattgaaacctcccccaaagcagttccaggatgaagagaatggtataatagatcgctcaggaactaagttacaactctctagttcatggtcagtcatgccctctgacaatccacatgagttgactgagtctgatttgaagctttctgtgacgtctaatccatctcataagcaggcaggattgggaaaatggagtggcttggatcctcccccacttctttctgatgttggatccaaagaatcagaaggaaactggtttgtatcattaatctcacaacctcaagtagacttttctggaacacatgctcccggacagctggaaagaaatcctgctagaagtcatggaaccagcaacctgggaatggctgtgcagcagtcgactctccagtcccgggaaatgctggaagagaagggagtattatctggtgcacgatctgcagattgcaagttgtttggttttcacttgattgaaaattcagttggtgaactgaccccgtcaacaatcagaggtttagcagctggagaggatatacatgtttcagttcctaatataacagtacatgaggcacagtcagaatcagatccacattttgaaccatcgagtatggccaaaatggatatgccagcagcaattactgatgaagaaaaaagttctcaaaaatcatccaaagaaactcatagcagacctcaaactaactcgacaaggagttgcacaaaggtccacaaacagggtagtgctcttggtagggctgtggatcttactaaatttgaagggtatacggaactcattcgtgaactagaacagatgtttaacattgaaggagaacttgaggatccaagcaaaggttggcaggttgtatacactgacaatgaaggggatatgatgcttgttggagatgatccatggcaagagttctgtagcattgtgcggaaaatttacatttatacgcgtgaagaggttgaaaaaatgaccccacaaaccccaagtgcgaagctcaagggatgttcagaagagcctgtcacaagagaaacttcccggagttctgatcgtcaagattcatcaattgctggggtcaccgctgaaaggagttctgatgcctgataccatttcaatctgcatgttggtcacttctgtcgggcctgctaaaggggcatcaaagggcatgttttagttggccgtttgatgcttgggaccagcagcgcagttgaatgaaccttgtaagaatgtacttgatatgtaatgtattttcatttcatctgcttagtttcaacgtccagcctaaatgttgaaggcaatcgtggtgcagttagtaaggcttgttttacaatttgacaagcttataggattagacagtttagttatctgcaatttgccttctgtacgagtttcattttcttaaatgcctagactgaaggatatattataatcccaatttttggaggtcttgtcgttgatctggatcttaacagaaaatgtgtcaagcattttctaagatacttgattttcgaatatcatttgcaagggaagaattgtacatatgattaattcttggatctctatgttttttttaaaaaaaaaa

SEQ ID NO: 1832 - DNA, 2095 bp, Pinus radiata
atagcatcatatactgattccatcggaagtgatagtcagatgcccatttcattagagccttgatgaatatgggggagcattttgcaagttctccccagattttaagcttgtttccccaaaacccaattgtaatggaggagcagagggatgtgcaggggagtggatcaatgcaaaacggaagcgagcttgcagaatatcatttgggttcttcgatggggttatttcagggatacccatacagccaacaggtgtacccatctcctctagcagaacacgaggcattgctcgctaaccgtacatacttctgcgctttattcaacgagtttcatgcaggtctcggaaccagcctaacagttcctaacataggaggcgaggaattagacctacatttgttgtacagacaagtaactgcttgtggtgggcttgaacaggttattaaagagagaagatggaaggaaatagcgacagctttaaaactccctagctcaatcataacctactcgtttgtgcttcgcaaacattacatagatctgctgtaccactttgagcaagttcattactttggagcacggggacaacttgctcctcctcctggtccattgcctgctcctcgtccttctactaagtccatggacaatggcattacatgccaacttctggttgatccaaagcagccagcaaagaaaaggaaaaacatagttgatcccgctcagctgtttggagtggatccaggtgcatatgttgggcaaactgtgacaggagcagtcgatcagagatttgagaatggctacttggtgactgtggtggtaggctcagaaaaacttaagggtgttttatatcatgttcctacagagaccactgttcagcaatatgcagtggttccagggctgatgagcaatgtaggctgtgatgcccttgggctggaggtgcaggtaacgaagaagaggaaagaaagggtacataatagagatcccagtgccccgcgtctatcaaaaaatggttacaaattcttttatgtcgagcaatgctctaggttaaaaaagacatatgcacagacagaccgtgaaattgttaagacggtgaatgatttgtggaacaagctttcagataatgaaaaaatgcaatacattgaacggagtcaacaggataaaaaaaggtccaagacacagatgatggcatacaaagagagaataaaattgcaggaacgtagtgaagggtacaatggtgacaaaacttccgaggtcgttggtccgaagattgaaggaaatgtgactgcacccttctttcatgacaatagctatgattaccacgtgtcactggaagcaggagcagatgcaaactctttccattcacatcagcaacgaggaatttcatcagaagtaagtggcattccagttgcagaccatggagcatattcgggtgaaggagataaaagtgtctattctgtttgttttcctccgccagagatttctgcccctaactttgggggttctagtttaccgcagacgtatgtaggttctagtgatcagtttttctaccaaactcaatctagtgcctttcagtctagctttatgccttactctatgactccagatcaaatatactggatgcaaggtggacaatctttcaatagtcaagacggacagaccttgagtctttacccacaaaatcctttcatttagtatggttcatgtccttgtatatttcaaaagttctggtcactcaggggtatagtattctgaattttcacattactgttttttgtccattctgctacagaagcttctgagcagaatcagttcatgtataataagtgtatttatgagcatctgcaccatgtgtaagggactcctaggtcgtgttcgaatttctgcctttgtattcctctccctaattttaggccagatggtttttggtttcttggcagagttcatgttattttgcagcagttcattggctactctccaagcaaaagagtatcttgtatattcaagtgccgacaagttttctttgagaaggttgccattttgctcgatgcttgtgaatggttttgccatcacagaaacgttatataatgctcattgtacttaaaagg

SEQ ID NO: 1833 - DNA, 1782 bp, Pinus radiata
gtgaggatgcatcacccgctgtgaccaacaatatgcaaatgcaggtctttggtggtggtgggggagatgctcaccaggtttatccagagccccttgcaacccacagagaagtggttgcagacagagacttgtttcttgccacgctcataaagttccatgccgctctcggaaccagattatcaattccaaagattggaggcagggatttggatcttcactatctgtacaaggaagtgagtgggcgcggtgggctgcaaatggttattaaagaaagaaaatggaaggagatagccttggcacttgactttcctccaacaacaacaagtgcttcatatgttttacgcaagttctacagtaattttcttcaccactatgagcaagtatatctgtttggagttaaaggacacctggttccacctccagctcccccagcaaacccatgtccacctgctcattcctcagaggttgagcatatgcaatcaacttcagaagatcctgaaccagagatgaggaagaggaaaatagattctgctcaagcactgggagtggatcctgcatcatcaattgggagcactgtgatggggtctattgatggtaaatttgagcatggttatctcattactgtgatggttggtacaaggaaaatgaaaggtgtgctgtaccatatacctccgactggtgccagaccacaaggtgcatctgtatcgacctttatgaataacatcataactggcgctgaggctttacaaattgagaatcaaattggtcgtcggcgtaagaaaaaagaaatgtcacggaaggatccaaatgcaccaaggcaaaacagaagtggctacacctttttcttcgctgaacagcgagccaagttgaagtcaactgaacctgataagaacagagaaatcagcaagatgattggtgatttgtggaatcaccttccagaagacaagaaatcaccttatcaagaaagaggcctacaggataaggagcgctataaaagagaaatgcgtgaatacagggaaaggatcagatttaatggggaacaggttgttgatggagcaaatctccatcaaactggcctgcacttgggaagaaatgacaatgttacaaagaatgatgtgtgtgatacagcttagatttaactagactctgcgacccctgcgttagtgtgcaagagggtgggtttgtcatttcagggtacatatttatggttctggtacaggaaaggtggatgtgcaatcttccaaagaaatgagagttgggttcccctcagggaggcaaggtgtcacctgtctagagggctagtaacttcattgttattcaagggtgcatttctctgtattaaagccccattgtgtctccagtgacttgttaattgttttagacctcatggcctgcgttatctaattgggttttagagcacaattcttgcaaagacgtatcaaaatttttgaagagagagggtgggtgacaaggaactatatatttctcatattgctaattgcgtgggtcagatagatgtgtaaatatgtagtcttctcagagggtattaccatacagctattttaggtatagacttctatgtgtattggaatggttcaagtttgcttggatttactaagatgatcttatattttacttcacccggctgctgatgctgggggactgtttgagcttttgttcctgatccggtaatgcaaacaaaagatgaactatagaaattatgctcataaatagtaaattagtaattcagcactccgaagaggtaattttttaaaaaaaaaa

SEQ ID NO: 1834 - DNA, 3153 bp, Pinus radiata
atttttttctgtatcagactcccgctcgttttctctttcccttctttcaccatccgcttcctcgctcggctccgtgcgcctcgtgttttccgcaagtccgagggtcgaatccctctgcgtcacaaaaccctactgtaagtgtaatttatgtagaaatgcagcctcaggcgcaggaggatcccccacaagaatttcacgaatacccccaaatacagttcccgctgggttccatgggcacgctagaggtgcccaaaaatcatcgtaagatgcctttcgaggggctgtccctgtttcccgagaacacagagcagataggggaagagcaaaacgagcagcagttaggtcgtggtcacgtcgaagaagttgaggggcagcaacaattggcgacgtcaggttatcatgtgcccccagggatcaatattttctcccctccaatagcagagcacgacacattgctggcgagcccggaccttttcgaggaggcgcttggaacatttcacggttctcttgggaggaggctaactgtgccacatatagaagggcaggagttggacttacatgcattctatagggaagtcactgcatgtggtgggctagagcaggttattagagacagaaggtggagagaagttgctagagcattaaactttcctggctcaattatcaatccctcctttgttctccgcaagcattacatagatttgctttatcattttgagaaaatctactacttcaaagcacatggacaacttccttatcctcctggaccgttacctgctccacttcccattgtaaaatccattgacgataagattgcttatcaaatcccagttggttcagcacaatctgttaagaaaagaaggaagattgatcctacccagttgtttggagtgaatcctggtgcatctgttgggcatattacaacaggagcaattgatggtaaatttgataatggatactttattacagtagtagtagggtcagaaaaactgcatggtattttatatcatgtgcctactgagaatgctagcccacaatttgcaactattcctgggcttataaggagtgtaggatctgagctggatgccttggggcttcaggtgcaagtcaataaaaagaagaaagaaactccgtctaagaaagatcctaatgctccacgtccagcaaaaaaaagttacaactttttttatgctgagcaatgtgccagattaaaaaaaaatcattcacagacacatcgtgaacttgcaagaatggttgccgatttgtggaacaatctttcagacaatgaaaaactgccatacattgaacaaagtcggcgtgaaagggagaggtacaagagggagatggaggactacaaaaagaggcttagagtcgaggctcatggtgaagtcaatattggttcggatactgttgatgttgttgggcaggaaaatgaaggacctgacgttaacacattctatcaggatggaagtcatgattatcatgtatcattggacacagatgcagatatgaattctttccatatgcatcagcaacaagaagctgatgttccggttgcagagcctcaaatatattctaaccaagcagatggtgatgtttattctgttgtcttgcccgagccacaggtctctgaattccagttagaaacctctggctgtttgacacagacatatggagcttcaggagatggttactcttatcagaatgccacacttctgccaaatgtttgtcagcccggctttgtgtcttgcccaatgtcttcagatcaagtccactgggtccaggaaggtagccatcctttttgtgttcaggaggatcctcaggtctagactctgtaccgagagtcattttgagtttagcagaattgttcatatcctgttgaagttttaaattgctggtcaccttgaaggacagttttgtgaaataattttcttgtccttcctgcttcagtgatatttggatctgagcagaagcggttgctagttttcatgtatcatatggttattaaagcacatcctgtagtttgttatttccatgaggccatgaggttcacatgatgtgcagcagacatttatgaaatcttttgtagtttttttgaacctgattgcatgacagcttgtttcttcgaaagaaacttgttttacatgtttctcagaaaaaaagggagttcttgtatgggaaactggagaatctcacaacagtgtaaaatcagaaagttttttgagccatatatgaatttaataaattatattttgaaagtattttcaagaatcatacacatataggtgctttgtgttgttgcttcttccattcctaatccaaccagtattctgatctttgttgcttctctctggcgaggtgggtatctgaacaatggccaagctatccgctttctgtggcttgatcgccctttttgccttgttgggtgttgccaatgcccatgctggccataacttttatgttacgggcaaggtttactgcgataactgtgctgctggattccccaccaggatttcacctgccatatctggtgccactgtaggtgttgagtgcaaggatcgtgctggtaagagattgttctataatgaacagcacaccgacaacgatgggctttttagtatctctgttctgggtgagcacgagcacgaagcctgtgaggcatttacagtgagcagcccaacctcatgcaaccttaaaactgatagcagccgcggtccagtttacctaacccacaacaatgggattaattcggacgaaagaaagactggaccttttgccttcagacctaccacaaaccaccctgcttgtcaggctgtgttggcagaatataacatatataatgactctgactaggttttattgcctctccattcgtttgtgtcggttttcgggttttcatcgcttctttctgttatgggttttggctgagtcctgctactatttcttttgggttctcctgcctgaggatctgtgccacaagtgaatataaatataaaatgttgttgtgcttaggtggactatttatctattgtgatggtattgatgaatacctggattcatttgtggctaagactgcaaaagtttggaataatttcaatttcatattctatatatatatatatatatatgttgcattgcttttgaaaaaaaaaa

SEQ ID NO: 1835 - DNA, 2984 bp, Pinus radiata
caatgtgtgtgtgtggagggagtagtctggtttaggctgtccatgcttttgatcaggaattatgtttcccattatttgatgagacctggacctggcatagaagaagtcattggtactgctttttaatagcaaggttcaagcttactgcacatgttgtgggattcctgtcacagggaacatcgagcttgattctgaaataattagtgtcattctagtattaaaggctaatgttaccataggaattattggttttgtttgactgcaataatggagtcatggtaggcatcaaaccatcagatgaattgttactgttattaatgcatttgaagttcttcatgacagagatgagtgtgcttcttttttggtagtctataaaaattatttattgaagtttcttgcttaccaggactacttcctgcttgttgcagttgttggttttgttatttatctttgtatcgttgtcccgtacattcctttgggctgtgtatgatttgcagggaaaagtaagcagcagtgtggaaggattgattttgttgcccttttttatgttttggtttgttgttctgtgataacccaagtaggattcgaggataacagtggcggactagattactgaatatcggcattgctttggagattctcattctgatgcatgtagcgaaccagccagtgaagtttacagcgcgcagtatcctgatttcgtgaagtaagaggggtgtaatgtcgtctaatattaatgtttatatcgaggagggcttgagcaaagcccccactccagcttcttcaactatagcagatggcagcagtcagaataacccagggggactgaaggagcacgattacatcggtctgtcggaagtttcctcgtcgatagagagctctgtggtctcttgtgatggtgaagagaacaatatgaacctcaaggaaactgagttgagattgggccttcctggttcactttctcctgcaagggactcatctgagctgaatttgttaagccctctgaacattaggacagaagtggaagagaagaatctgttccctgttgagaaacaacaacattcaacgaaggatggggtggcagaagagaagaatggacaagacaagtatattattcagccatctggaatgggaaggaacatgatgactgtatcacccaagaatattgtaactggttcaaagagaggcttttctgaagcgatggagtcgaggaactgtttcccggattctcgaaataatggattttcagcagagggtaagtgggtgtttcctgcacaggttggaggagttattgtggctggatccgaggttgaattgcccaagacaaccacacaaggaaagtttttgccgcaaggactagcatctgctccaggagcttctaccatgatgcaagggcctacatcctggcatacagggggcctggatcactcagggagctctttcatgtgttctaggagttccaatggaacaaacctcaatggaaaatccattaaggatggagttgcttcaactggtgtcaaagatattgcacagtctaagatgccgcaggagaggtctcgtactgaatcacagcatgggactaatcaaaaacaggtgccttctgcaaataaccctggaatggctcctgctgccaaggctcaggtggtaggttggccaccaattcgttctttcaggaagaacagtttggccgctccaaaatcaaatgatgaggatgatgtaaagtctggatcaagtgctttgtacgttaaagtcagcatggatggggctccttatctgcggaagatagacttgaaattatacaactgttaccttgaattatcgtctgcattagagaagatgttcagctgctttactatcggtcagtgtggatctcatggagtaccaggcagggacggtttgagtgagagcaaattgatggatctcctgcatggctcagaatatgtgcttacatatgaggacagggatggagattggatgcttgttggagacgttccatgggagatgttcaccgactcttgcaagaggttacgtatcatgaagggttctgaagcaattggcctagctcccagggccatggagaaatgtaaaaacaggaactagatgtgtagcatgacctgctcccaagtcactgtgggggttgacataggtccagatggagggacgtggagtagccaacgaatgaagtagattatgtttcttgtttcgttcttagacttccttatttgtcttgggcatcaaggtttgcccagccagtcagcaacaatgttgctcagcttatcatacatcttcttaagtgggcttggaaattcattgttggtactaagtctttggtggactgaagtgagagggacttggattttgtgacattggtatgcacaggtcaagaagcaggtcatgtatatctggaaggaaattaacagggagataattaaaattagaacagtgtctgttgtgttgttttattaggagttgaaatgcttgggaccaaaaataggcttatggtttggtgagacattatgtagactgaaatctatcactgaaaatctctggagcatatagatctagctctttcagcaagggaaatggacttattgaaggtcagaatcatcaaaattccagttgaccaattcaggagctatttacttttgaaatctggagggatgaagtgtaaaatcctttttaagattacgagagagacatttgctctcgatgtctttgcaatgcttatattggctactttattatggtttgggatgaatctattttcatccaccaaacggcatctgtcctgttttgtggaacttgttgctgcattgccgtttaggctgggtgaactctaaagactttggtagttttatttgactgaactatgagtttgataaaactcaatatgtcaatatgcagcttgaagtgtgacttaatatattattgtatagctttcaatgtttctatataaccaatgttggtttttctgaaaaaaaaaa

SEQ ID NO: 1836 - DNA, 1662 bp, Pinus radiata
aaagaaaggttctaatccggtggacgaagctggccaggctaagcttaatgatgtttctcctgttgagctgccttcttctctgaaggatctccgtttaccgttgcacccaggagcatatgattctcggttcatccaaagcggggagtctcagaaatgctggatgaactcattcaacagccgtgagttttctcaggttgtacaagattacaattacagggcccttcacgcggcatcgaagggtattgcttcaggagcaaagcgaggtttctctgatgctctgggagtgaatttgatgcgtgattctgggtttggattaccagagtcggactcaaagttgttgaatcagtcacagccaaggaatttcatatttccttgggctgttccgcagcagtatggtcctgcaaacgcttggctcacttgggagcagaaaagcaagcagaatttgcaacactattccaaggctttagcgaccagcgggattccagatgataaaacgaacaatcgatttggggagggtgctatatccacccaaaatactcaatctgtagtcaaagcttctcaggagagccagagaccgccggcgcctgttgctgcctctgaaaagatacaaaccccagctgagcctgatcgtgctccgaaccaaagtggaaccccttccagagcacccccggtggtaggatggcctcctatccggagcttcagaaagaatttggctgcgcaacccaaagtagccgcggccccctcttgcaatcctccacctccagcagcagatcaaggggaaaagaaaatcaacaccatgttcgtcaaagtaaatgtggatggcgtgcctataggccgcaaaattgacttgaaggcctatgacagttacgaaaagcttactgttgctctggatgaaatgttccgagtcgccataaatgctcaaacatcggatgcaaatcctttacctgaaaataataataaccaggcgagtctcttgaatggaagggactatgtttttgtgtacgaggacaatgaaggagatcgcatgcttgttggagatgtgccttgggacatgtttgtgaagtctgtgaagagattgcgagtaatgaagagttcagatgttcgtcgtctagcaaacaggacccagtgatcccaactgcctaatgctgctggaatcaagaggggaaccctagcaagtttatctcacagtaaccctaagaaagaagatgaacccaatgttccttttctctgagagagtttacgcgcgccattttatccagctgcattgtggagtgaaactggagaggagtttttgtagcatatactggacaaagttaaggtcaatagaatagtgttgaaagattcagttcattgagagatcagtaagacgggttgagcaaaataaaacagtgaatggtgtaaagatggctggtttggtccagtgagacctagtttcctttatttttttcttggtgttgattgtactaccttgttcgattattaaatgtttgttgttcaagataccatgctttgttcagcgactgtacgccattgcagagcttcacgacgctgacagttcgtacgactccagtgagaacctacaggtatgtgattagctaacagcgcaaaccatggagtcactcttctgttcgtctccttatattgtatattattaattcccac

SEQ ID NO: 1837 - DNA, 3529 bp, Pinus radiata
tctcggtcgtcttcttctgcagctgcctttgccttcttctcctgcgctggtttacttcgctgatgcaaatctacccctctggctctgctggttcttcatcatcaatttgggccagttgagcctcatagatgccctgggcaggaaggaatagtaatcctgtcaggccacctcctgggaatgaagaaggaggcctgtgcaacaggatagcggataagagccacaaggagcttcccaggcccaacgaatcactcttctgccagcaaattgatctcaaagataccatgaatcattgtgttcccaattgggatatggaaaatgggattattcaatcttctgatttcccgcctatggcaaaggtgaattgggattatgtacaaccgcagaagagatccacgatgttagagcatgatatcgaagaacttctatgggaaaatggtcaggttgtgaacaaagtggtcaagcgtccttttccaactcaactgtcaaaaacattacaaaatgatgatgctgtgttacctgggaagccttcccctgtgggaaaggataacactctggaatcggttgtacatgccatgtcatcagccaatgctagttccatccatgaagatgtaatggattcgtggttgcactaccctcttgatgattcattggaaaaggaatactgctctgacttctttgtagggattcctggtacaaacgttcacatgctcagagattcactctcaggacagatgaataatgtacctgctgaaaaggtttccaatcttcatgcacagaaagaatcttctttatcaagtgagaacaattctgccccttggacaggagtatttgcaggtatggtcaatggtacaaacgctgcaggtccaagtaaaacaggcaaggaatctccaccaaaatcaattatttcagacaaggccatggctctgggtgcgggaagagcatctgggataatttcccaatctggtacagacacatttgccaaagtcaggactacaaatcaattaccagtctccaaatggcatactgatgttcagggttccagtagttcaaatgatgatcagcctccttgtaaaaagactgctacccagttatctagttctccattgtcaatgccaccacccaaaatgcaggcaactgatttagcatccatgaagcctagcaggacaaaattagtgaacttttcccatttctctaggccagcagctacaatgaaagcgaatctgcaaagcataggctcagctagtgggctatcaacaacaggaatacagaatagactggacaaaataagaatggatggaaatgcggctgctgaaccctccataattgagtcaaactctactggcatgactacaattgggtccagcagtggtgccaacagtcaagcacaagatattggctcttgtcaaactcatcaaaatccacccgttgggaaaaatttggatgtagcaacatgttcagaagatgtaacagattccagtcctaaagtttcggagcaggtattacgccaaaattcagatgctggcagaagtttggcctcctgtgggacagagaaatgtggtgatgctggggatggtccagagccaacaattacttcctcttctggaggttcaggtaatagtgcaggaagggcaggaaaggaggctaccaataccagcaagaggaagagtagagatgtggaggactctgagtgccaaagtgaggatgttgaatatgaatctgcagaagcaaagaagccagctccgtcacgcactacaacctccaaaaggagtcgtgctgcagaagttcataatttgtcagaaaggaggcgaagggacaggataaatgagaaaatgagggctttacaagagcttatacctcactgtaacaagtctgacaaagcttcgatgctggatgaagctattgagtacttgaaaacacttcaattgcaagtacagataatgtcaatgggaggtggaatgggtatgcctccgtttgtgtttcctggaggtatgcagcattttcaggtaccacagatggcacatctgtctcctatgggcatgggcataggtatgggatacagcatgggaatgctagatatggctgccacttcaggtcgacctgttatgtcattgccttccatgcatgtatcagcacttcctggttctacaattcattgccaagctgcattgcccttgtctggaatgcctggaccaagccttccaatgtccaggcttcctggaccgggattacaagtatcagggctgcctgtatcaactcttccggtgtctggcttacctggaacaactcagcctggattagtctcaacctcagcttcaggctccactgatttgcaggaccatatgcagaacgcaaatgtgatgggtcattataaacattatatgaatcatcatcagatgcaagggctgcctcaggtactaaatggaaacttgtataattcttcaatggcacaaccagctcctcaaaatccagttcagtccgatggtaggggagcccacaatacagttagtgcatctggaaaggccggcaccactggtaagcattatgacttattattttttctctttgttgagaaaatgaatttttatattacattattgataaggaataaatttacatcgtttgcaacatcagagagctaaggctgactatagaggcctccttgtccaacaaaaacaagagggccaacatttaatcagcctagaatgattgtcatcttcacattgatgttcttatttttttcagaagtagttttatgggttctcagtggctgcatatcatgaatgggttttcagctgcaatcctttttccttgtgggttttgtggccattatatttttgcttgctgtcacagggaccatcttgttgtttgatattattcactgcgcctcttgaatatattgcaggctagaaatggcaccaatgaatcattttcatcaattttttttttctgggaatgcccaaagcggatacgaggctgggattgatccctttctgcgaatggattcttgagtctcctgggaacaagtcacagtgacaaagctgccctgacttggaggcttctggggtgttttgcagtttgtatattagttttggaaaagcactggtcttatatttagttacatcttccaaaggtttttagtggccccaaatatgtatcacaaaagatctagctgccacatggtgatagtgtcaattaaacgatgcaaattgcatattttgcatcgagtatgtctatcgagatcccctctaacatgccagtgctaccttatacatggtcaagttttctgtaattattcttacaatgttgatcatgccgggagcttaaaggatgtttaaaagctccgaggcatttcaacccattcatttttgatagatgtttgttttctttctagatgtgagaaaatagtctcatttctatttgtttaggagcatttcctaaggtggtctgtgctctcaaggctgaaggtgtatgctataagcttaatgaagttggaaatgatatcaacaaactcctactttcaaaaaaaaaa

SEQ ID NO: 1838 - DNA, 1116 bp, Pinus radiata
actgtgtataccagaaaattgcataattgtattaaggtaattaaaccactacggcagggcaattatagtttaatgtccgaaggcttttccttcggaagatgcaggcactagatctgcaagggtatagagctgaaggtctctgatccaaaaacagataaaaatcccgagcacaactgcttctctgtgaatggacgcaagaatgcagtctcattattatgaggatcaacatagtcagatgtggatggatgaatttccagggcacttggattgggatgacagcgatccagagatcatgcagctctccaagcctgcaaataaagtaaataattatgttgtcgaagctgctgcttccaagaatttgcactccgaaagaaagcgaaggaagaaattaaacgacactctttacacactgcgctctgttgttcccaagatcagcaagatggacaaacaatctataataggggacgctataagccatgtgttagatctgcaaaagaatatccaagagattgagggtgaaatcaaaggattgtgcagctcaaacgaaggagatgatgatactcaaactcctacagatattaaaaagcctctgacaaaacctagtttggaaaaacggtgcaccgaatccagcgatgcgaagaaatcggtggataaattcaaagtcaaacgtcgaaaagcatcggagacaaaaattgtggaaatttgcaaagccggaaaagacggaatatatcaggtgcgaatagagtgcaagaaagatgcaggcttgttagtagatttaatgcgagccctggaatcagttccattggagatcgtgaattcaaatctgtgccgtttccatgaagccattcatggcacattctacgtgcggtcacttaaaaatgtgggggctgacgaattggaggacatgattcgccaaaccatcgccagtgattgctccagctgaatttagtcaaagattagtgattgactccatagccatgtttgctacagctgaatttagttaaagattagtgacggttaatctgactccatagccatgtttccagagcttttcagcgcgaggtgctgttgtttgtgtgatgtcaaaattacaattagatttctggcttgaaaacg

SEQ ID NO: 1839 - DNA, 1128 bp, Pinus radiata
ctagagcagtggcaatagttttgcgcccgaaggactttccttcccttgcaggataccagcaacggctgtggaggggaacagatgagagagggtctctaatcccaaaacagatataaattcagctgggagggcacaagtgcttctctgggaatggacacgcgaatgcagcgcgccggtgaagtttcgaagtgtcattattatgaggatgaacatgataagctgtggatggatgaaattgcagggcactttgagtgggatgacagcgatccacaaatcatgcggctccccaagcctggaaataaagtaaacaattatgttgttgaagctgctgcttccaagaatttgcactccgaaagaaagcgaaggaagaaattaaacgacactctttacacactgcgttctgtggtgcccaacatcagcaagatggacaaacagtctatcataggggacgctataaaccatgtgttagatctgcaaaagaagatcgcagagattgagggcgagatcaaaggtctgtgcaactcaaacaaaggcgatgatccacatataaggacgcctcccacaaaacctaatctggaagaccggtccgccaccgaatccgaatccggagatgcgaagaaatgggttaataaattgaaagacggaaaagtattggaagcgaaaattgtggaaattaacaaagcgggaaaagacggaatgtatcaagtgcgaatggagtgcaataaagatgcgagcgcattagtagatttaacgcgagccgtggaatcagttccacttgagatcgtgaattcaaatatatgccgtttccatcaagccattcactgcacactctacgtgcgctcacttgaaaatgcaggggcccacgaattgggcgacatgattctccagaccatcgccagtaattgctctacctaaattcattccgacataagcgccggttaatttctgtaaattttgaagatcgcgcagaattagctggcatttgataaagggatttttaatgtcattgaaatcaatacagctaagtacaaatccggatttgtccttggccttcgcattatgtatatgaggtatttttaaccgagccatagtataaagaaacttgtttcacttgatgtaaaaaaaaaa

SEQ ID NO: 1840 - DNA, 1949 bp, Pinus radiata
agggagtcggtgctgaaaaagcaaaaggtaaaccaccaccacccaccaccgaaaatccccccgccatatagaaatgtgacagagaaagaaaacgaaaagcaaaaaaaaaaaaggtggaagcatggagtttattaaattctgaaatggaatttatcagctcctctgcttcaaaagtacggcggttcagtgcctgcggttatagttggattcgagctgtatgccggacatgaaaggcgacctcgaagctgtcaagagtgaaacttgagcgacagttctgacttatgcttatgtccttcgtgccctggaattttccgcctgaacgaagtcatttcggtatagctgttgtttgcttcgactttcgattcataggccggagctttgcttgaggagtagcggttttggttttccaaggggcgaaaatatgcagaatggtgggatgactctggcagcacagatggaggaacgcaaatcgaggtcgttatcggattcatgggccaagctcttggacactggaacgggtctgccggaccatggcgtcagtgttattaatcacgccacgctctgggaccacattcgaacgccgctgtatggcatggagagcagcagcaccagcacggcggagattaaagattgctggatgaattcacccgcgggaaatgatgtgtcttggccgagtaatgaggtgaaaattctaccaagttcgcagcacagcaggcaaatcgctgaacagaaccgttggattgcgtccagctctccgttctgcagtagcagtaataataacaataataataacaaaactgacgacaacaaaagcaacaataataatgcccatgggaacagggaggcgttttgttacagcgacggcaatgcagggaagttcttgtttcgaccggacgcgtttccttgcggccctttcactaagctccttgatcctaccaacaccttgccacctgattcgctggacctcgagctggaaggatttccagcctccagcaaagtatcaattccgcttgttcagcttcctggcccgcttaaagctcccgctacttttccgtcatcaaatatcctaacattccagagtaatatgaacaaactggacatgccttatactagcccaagccctaaacctgttggacctgttatcgtccaacagcagaagtccggaggcagcccctccagttctccttccacatcttcgagcaataataatttgcaaaagaatgctgttgatgaaggtggagagtgcactactgaacagaagagaagcagcgatcaagccgggctttccaatgcggctttcaagaaacctagaacagaagcttctgcgggccctccgatgaaggtgcgcaaagagaagctaggcgaacgcattacggcgttgcagcagctcgtctcgccgtttggaaagaccgatacggcatctgttctttttgaagccatgggatacattaaattcctgcaagatcaggttcaggtattgagctcaccttatctcaaaggcattccctccagccagaaggacgggcgaggagatcaggcgaaatacgaccttaggagcagaggattatgcctagttcctgtttcgtgtactctccatgtagccaacaacaatggggcagatttctggacatctggtatcggaagcggttccaagttttgaacatcttgcaggcccccttttttgttgtttttctttttcagtctgttcctgcgtttttcaacggaacagttgtcacctttaccacataaattcaaagctataatagtagaaaagcagaaagatgaagacgggacgaaagcagtcctgtcttcgatgtcccatttagattatgattctgtgatatatataaaaaatatgtatatgtctgagaaaagcagatcctacctgcaaaagatgctatactgctttttccacccttatcaattgacgccattttgcaaaaaaaaaa

SEQ ID NO: 1841 - DNA, 2765 bp, Pinus radiata
aggtgattttaatccattcgggcagcgacattcgagagccgagcgagttctgagtagaagaaacgagctatccagctctttagatggcgcaggatcgaatcctaggggctagaaatggctgataatcattagatttcgctggaatatgcatccaaaagctacatgctcatcggttctcgcatataaaagctaaatcatatatggtagctgttgccataattaatcgatatatagaacactagtgagttatagatatagattgagagcattgaggattgattggggataaaaatgttgtcgagaatgaatgtgaatggtggcatgtggggtctggaagatgccacagacctccactgcaacaacgacgagaatttgaatttgccaacgttcaaggcaatgctggacgcggaagaatggtttacttctcacagcaatactaaccataacgatatagctactgccagtataaataatgctaacagccatcctgagggcccctgtttcaatatagatatgaaggattttggatgctattcatctctggtcaatccgaatcccgagcctcccaatatgctgttacagcacgccatgaattcttgttcatcttcgcccacttcgattttcagcctggacccttcgcaggtccagtcttttctagctggggggagccaccatcatcagcatcatcttcatcatcaccatgctccccagctctcggacgttgtgggttcgagtcccttccaggagttagcctgcgaggggttggtgagcagcaacaatgccagtagcaacagtagcagcaatagctacttgtatggggggctgtcgggaggaattttcaggcagctgagtcccagcttcgcaggttcgagtccccgcacgaacgctgctaccccgacgcctaatctcagcagcccacacagccaggtgggtggtagtattacctccaatctgagccctagaatgatgcccgcgagcaatctgaatctttcggacaccggattgtttgctggcaataatcacaacaccaacaacagcaataataatctgagcaatcttctgggtttgagtagtcttgttagtcctcgactccctgcgccattaaattttagcagcccgaagatgcttagaccccttgagatttgcgccccagtgggtgctcagcctactttgtttcagaagcgggctgctctcaggcatacttccctcagcccatgtgcaacaaccccttgcattgaagtgctcgatgaagagagccccaatggcaatagcaatagcaatgtgaaagggaagaggaagttgatgtcggtgggggctgataagaaagaagaggaggatgtggatgaaagcaatgatggttctggggttcagtatgattcggatgatgtgggcggtaacaataatagtagttataaggtcgaccagattggggaagatggcttggcctctgcaggaggcactgggaatgctgctgctgttaataacaatagtaatggcggtggagataagggcaagaagaagggcttgccagctaagaatctgatggccgaacgaaggcgccgaaagaagctcaatgataggctttacatgcttcggtctgtcgttcctaagatcagcaagatggatcgagcctctattctgggagatgcaattgagtatttgaaagagcttcttcagaagataaacgaccttcacaatgagcttgaatctacgtctcagggacctgttttacctggcacatctaatttccatcctttgacacctacaacaccttctttgccttgccgagtgaaagaagagtgtccaacttcacttcccagtcccaatgcacagcctgcaagggtggaagttcggatgagggaagggcatgccttaaatatccatatgttttgtgctagacggcctggactgctactctccactatgagggcactggatgggcttgggcttgatgttcagcaagccgtcatcagttgcttcaatggatttgcactagatgtatttcgggcagagcaagctaaagaaggagaaattgcacctgaggagatcaaagctgtgctgctacatactgcaagctgtcatactgcaatatagcctaaagaatgcccatggctgcagaacatgtatattatgtcataacttctcaaattgctctgacccagctgatgtgcttggaaaatatcaaattaagcatcttatggggatggcaactgtccactgatgtcaatctggagttgttacgagtaatcatgcaacatcaacaggagaccgttctgtgattgttccaagtcctgggctgagcattgcttctaatatgtttcaatactaagaggtctatttagaattatatctccatccccaaaggctggaagtttggcatctgaacatacaagccacgtccttattttacttgccctatgtattgttggttttctttcacatgaaaaatgcaaacagatggtggtctttttgtaaacaagttctttgcaaagagttgggcagctgcaggcattactttcttaaatgaaactatcattatttcatttgaacacttggtagaatgtactgtcttgctggaaggactcgaaggtaaaacgaatttaccttcttggaaatgaaggaatcaagttcctcctgtttagagatcatatacgggtacagtggtacactctaaatactgtctccaagctgtgtgctgtttttaactttttattaagtaagttttggattaaactagtgcaattttccccttttcaaaaaaaaaa

SEQ ID NO: 1842 - DNA, 2537 bp, Pinus radiata
gaaattaaggttcttgattttggttttggtttgaacgcctatttcatctggagttaaggcactgattggatggaaatcgtgcttgtagcgcgcagttgtcgttggtcgatgctcgccgtcgtttaaagatcacggtgaaactgtgaagattgtgctgctgttgtttgcattcgttgtgatttttgaagaacagtatgggagccgaaacggcagcagcattgaagttttggaacgatgaagataaagacatggtgaaagcggttcttgggcctaacgccttcgagcatttgataatgagctttctttcttgcgaaggacttgttgccggtgtcagtgatagtgcattgcagcaaaagcttcaattcttggtcgaattctcctcatccattacttggacctattctattttctggcaactctcaagatccaaagcaggtgattatgtgctcgggtggggtgacggttacttcaaagaaccaaagcatggggatgaaatgactcgaagatttaacgagtccgaaacagagcaacggatgaagaaaaaggtgcttcaaaagctccatattttcttcggtggagcaaaagatgatgattttgctatgggattagataatgtatctgacacagagatgttttatctgacgtccatgtattactcatttccgcgaggtgtgggagtacctgggagggctcttggctcaggacaatatatttggctcaaggatgcacatagaacgtccaatagtatctcttcaaggtcctttgttgccagatctggaggcatccagaccatactttgcgtgccaactgacaatggtgtcgtagaattgggatcgattgattctattaaggaaaataaagagtttgtgcaaatgatcaggtccatcttcaatgatcatcgtgtccagcaacttggacattctagaggctctgctttatcacagagccctgctagagtacctgacattctccctctttcgagggagaaggaaggtcatgcaagagctgtggtaccttttaagctttttgaatatggagatcatcagaaagctgttgcacaagattatagcaaagtttttggtcaggaccttaagtctgggaaaacaagaactctggtagatcataaatttgtctcgtcaaaaatggagagtcggtttctccatccagtttttcgagcacctaatgaacaccagcacgagtattatctgaatgacgataaaatattttatgggagcaataaaaaagggtttcaatctataactttgaaccaagtctgtaacagtaaaggaggggatatatataacagtcgtcatgattatcatcaacaaaagcaagagattggttttgtgattcccaataatgatattggtagtcaacatgttcatcataacaattttaaatgcagcaaagaggagaataaaatcaaagaacagcaacatcaacaacagcaatcccaaatggaattttctgggactagtagtattgtgtcatttcgtccttgtatggctgaatcagagcactcagatgcagaggcttcatgtaaagacgacaagtctccccttgttgatgagcgaaggccaagaaaacgagggagaaaacctgccaatggaagagaagaacctctcaatcatgttgaagcggagcgtcaaagacgggagaagcttaaccaacggttttatgcattgagagctgttgtgcccaaaatctccaaaatggataaagcttccttactgggggatgctattgcatatatccaagagcttcagaagaaactcaaggatatggaaaaggagaaggagacacaagaaaatacctctcatgcaccatctgtagctcctcaaaatatgctagctgtcgcaaacaccaattccatccctgacgttgatgttcaaacagtgaatggagatgctgtgataagagtaacctgcccacgggagtgtcatccagttgcaagagtgatgcttgctttgcaagaaatgcagttaaatgtacaacaggcagacatgtctactgctaaagagatgattcttcatacgtttgtagtcaagctcaatggtgcacaagaactgactaaagaaaaattagttgctgcaatttctggttaattgctcattcaagatgatgactagcaagattttgtctttggttaaacaaggacacaatccggttaaacaatgaaccaaaggggataagtagatggcagagccgtggaagcaaacttgaaggaacagtactctcaaatactgcttctgtgggcggaattgcatgaatctgatagcaggaaagagttactgatattattccagaacggagaagtgccaaggtgctgactgaatggcataaatactttccccacaggcctccagggaatgtatgcatgtactttcccaagtgatagcccaattcaatgcataggtaacttggacagggttcttccagttatttgctttgagtaataaaatattcttaatatggtcacaattgcggtgaagttcgattgattatcaaagttcaagggatttgcagcaaaaaaaaaa

SEQ ID NO: 1843 - DNA, 2372 bp, Pinus radiata
attcaagatctttgtatttgtaagggagagtagcttaaagttcctaaggacgaagaatttttctttggaggcggattttagtgcggttagagtcgaaatcagcaaaatagcttaaaacttcttaggacaaagtaattttgctttggagaagaagaatataggggattaagcgttcacatatgtccgttgaagagatcagctaaaggctttgacctcgcatcaagaatttcaacaataatttactgttgaaacgcggttgtgcagtctaggcagtaaaagatcgggaataagcaattcaaggataattgaattgtcgaaaaaggttccaagccttctttctttcctgtgaaagaggatgattttcttccagaaaaattaacggaagagactataggcaatgcatttccggctttggccggagaaaatcagtggaggtgagaaaaatttgcagacaattcaattatggatactttcatggcgtcatcaacgtcatcagcggtagatcaggggttcagccaagaaacattgcagcagcgtctgcaaattctggtagagacggcctcaatagtgtggacttatgcgattttttggcaagtttcttatgattctagcggtgccattcaactatgctggggagacggctactacaaggggtcgaggaacgcagaagaggacgagaggcttaggatgcgcagccgtttgaccgtaagccccgccgaacaggagttgaggaaaaaggtgttacgcgacttacattctatgattagcgggagcgatgaagtaaaccagcaggataatagtggtgttagcgtagatgaagaagttactgatgctgaatggttctatttaatatcaatgatgcaatcctttttatcggggtttggggtacccggtatggcattttctagcggagctcctgtttggatcgtcggagcggagagactgcaggtatcaaactgcgacagagcaaggcaagcttatgaacttgggattcaaacgctggtctgcgttccaattcagggcggcgtggttgaatttggatcgacggaagtgattgttgaaaactggttgtttctggagcaggtcaacaattcgtttaaatgtaacctcaaccaaatgcatgataacccctttcaaatccagtctttatggccagctgaaactttgagtgtaaaaagcagcaatactatgcaatccgctcaatgcattgagccagtgagcaatcctgaaatccagtccatgaactctgctttagctcgggaattacctgtgacaggcaaacaaaaagcatctgtgttcgctgaacatagttctttagtggttacagacgacaaaccattgctgcaaactctaactcaggagaccgaagcctttgaagcgccggccatccatattgcagaaacagtaggaccacaaacccgcacattgggttttaaaggcagtgaaaagaacgagataaagccagcaataaaagaggatacaattggtttaccgtctaatccgcctggaattgttataggaggtctgcgatctagcattgaatcagagctgtctgatgtagaaccctctgcctcaattaaagattcaacgtctgctctagtcgagagaaaaccaaggaaacgtgggagaaaacctgcaaatggccgtgaagaacctctgaatcatgttgaggctgagcggcaaaggcgtgagaaattgaaccagaaattttatgagcttcgtgccgtggttcctaatgtatcgaaaatggacaaagcttctctgctcggcgatgctgctgcttatatcaaagatctcttttccaaacagcaggatttggagtccgagagggttgatatgcaggttcaaattgacactataaagaaggaattattgatgaattctttgaagttggcagctaaagaagcaaaagatctttcaagcattgaccttaaaggttttagccaggggaaattccccggcttgaattcagaagttcgcattgttggccgagaggcgataataagaattcagtgtactaaacataatcatcctgttgcgagactgatgatagcactgcaagaacttgatttggaagttctccatgcaagtatttctactgtgaaggattccttaattatccagacagtcattgttaaaatgaccagaggtttgtacacggaagaccaacttcacgccctgctttgtaagaaagtcgctgaatctctgaattaagtagtggaatatcactacaatattgagaattttcctttgaatgctgcaccgtgaattgtgtttcggaaaggaaatggtgatggtgtcctccaacaccatttttccaatgaaaacaccattttgtaacataattcaagattttttgtagaaaaaaaaaa

SEQ ID NO: 1844 - DNA, 1718 bp, Pinus radiata
ctagactccggaagtagaccctccacttcctaggattatgctttctatgctgactccactccattgcctcgccatttaagcttactacagatagcgattccagcatcaacacgtctgtctattaaaatctcatagctgattggactagactcgtcagtgttgtagatctgcggcgacgagagaaggcacagaacatgcagatgcagatgcagaacatacattaattttcagcggaacagaggccaaaagtgtcatcttgcattggaatttgccatatcacacccatttccatttccatttccagatcaagcaaccctgtgcagcagaagctgaggagacgatgatggcacagaggcttgacatattaggaggcaatgattcttccatctctgaacatcaacagaccaatgctcattcagatctgacttcaaaggacaccgtcaatcacagaaaaagaaaatgcctctcaaaccccaaagttaaagttgcagatgcactctcaattcctctaaagatcaaggaaacaaatgaggctgagaggaatggaaagcactacaaagttggggagagtacaaaagacaaggatgatttaaaggataagcttgaagaatgtaacagtgctgaaacagctgaaagctgtcccaaacaaacagttgataatgtgaaaccttcttctgtaccagtcaagcaagactacattcatgtgagagcaagaagaggccaagcgaccgatagccatagcctggcagagagggttagacgagaaaagatcagcgaacggatgaaacttttgcaagaccttgtccctggatgtaataaggtaactgggaaagcggttatgcttgatgagataattaactatgtacaagcactacagtgtcaagtggagttcctctctatgaaacttgcagctgttaatccccagatggactataatgttgagggtggttatcttactagagatgtgcttcagccacattgctcctcagtaagtaagatgtttgctcctgaaacaactgcaaccacttctcagattaaccagttacaaaagacccccttgcaacatggcatgcaatgtagagcagacaggcaagaagttgccatcagagggatgatggatacacaattgacatgtatgaatggctatgcagatcctacttttcagttgcagatgtcacaaggctgggatgacgtgttccaaaatgtcgttgacataggattggatcaaaacagatccacttctttgaaatcacatggattccatggattgctacctacagggcacatgaaagttgagctttaattttaatcctgcctagctatatcgattcaaggagaactgtaactgtttaggcattccccaaagcaagattctggggacctaaaagcgtctaataccaggggaaaatggaattgggacatgcttactactcaatctgccagctgaagttgagaacctcattgttcttattcatctgtacatagatcacagatctttgaattgcgactgtgactgattaagatgattcatctcagaaacttagagattatctgtagagaatttcacccaatacagatgtacaatctaggatgctggtgcccttcattaatgcgtgctcaatttttattttatttgacagtcaaatttctctttgaatttacgactattacatcattcaggtaagagataagatctgcaaatcaatttaaaaaaaaaa

SEQ ID NO: 1845 - DNA, 2295 bp, Pinus radiata
gcagttcatgatgatgaaaaattgctcattaacccttcggagggaaggaagatcaatctagtctattatccaggaaaccctctaagcgaatgtttcagataaaaagagaaggacctagattcatccccgccatcatactcgtctcgactgttctcttggatttgatgcgaatacgactaatgtatgtagcacggcgttgatgtcatcgctactgtgttataattgaggttgtagctgaatataaatgctaaattagtggacaatttctggagatggcgggtgtttcaagcggaaattacttgtggagcgccgaatcgagggtaggtccttcggctaattctgtgtggagtagcattcttcttcaaacaaccgagatgcaggccgcgttgccttgcagctctaccagtgcttgtctgaaatggggaatctggccgactggccttctgcagatgtctgtgatatgacgccaaattcggcctgcgatgttaacgtcgtcgccggttcgatccccactgtctcatccgatctcaacatggccttcacgaatttgggtcgtccggagcttggagattctgccagtctcttggacccgactgcacaaatgggtgcctttgcaactgcacttcatgatcagagccatgtttggagtcaagccatgctgaaccgtggtggagaatccatgcagaacgcagtggaaagcttccaagacgtgttatactcgaggcaaaacggatccccccaaaaactcaaggagctagaggacgtttcagcaggttgggagttgaggaacttcacagctttccaaggagaagacaccagctgcttctctactgcagcaaaagaaaactcatatggtcctttacacaactgtaacaattccttgatagatttaggaagctccccatcgttacaacctgatggcttaactcctggtcatgtccccatcaatagtttcaattccagactagacctgcccataccccactttgacatcggcagagtaaagcaggaatttaacatgtcgtatgacaacccaggattagatgctcctcgtacactagtatcccaaggattcagatcggatccttgcagtaacgaagagcttttacgtattctggatttcccaatgaatcaaccatttctaaaaggcgccactgctcatggctttcacaatgcaacttctatgagaggagaggatcatcatcaacagcctcatgggctgtggccatctagcaatacctacagttctaggacgtttcctgctgcactctctcgacttctgccctcttctcccttgaagcaacctgcctcgaggctcttgactaacagcagaaacattccactgtggaactccatggcctccacaccagaaaagatgcagcagtccacaaattctacagatcgcgcctcatcgctacaatactgctcgccacaattcctgcaggaagggaagcaactgaataacacgacccaatcgcttaatatgccccgctgcgatgaagctcgagatgcaacaaatgatgcaaagagaagcagccctgatagcagttcgtcggattcgatcttcaaaaggcctcgtctagataatactaattctacccttcccacttttaaggtaaggaaagaaaaactaggggacagaattacagcgttacaacaactggtttcgccctttggcaagactgacactgcatctgtcttgtgggaagccattgtgtatattaaatctctacacgaacaagtacagaagctgagcatgccatatatgaacaagggagctgtcaactcggcccagggggtaaatcttcaggcacatgatcagatggattggagtgtatcatctgaagccgaggacacagacgaacccaaacaagatttaagaagtagagggctgtgcctggtacctgtttctagcaccttgagtgtggcctataatgacagtagtgctgattattggactcccacattcatctgtagttacagatgaagcaatactgtgctagttttagacaccactgtggaagtgtaattagggttttccttgctacataatttaatgcgcctgggaagttattctgcaaagcataagtaggcgcataacaaagaaagtacatcttgaattattaattcctaaacggcgctctattgagcatctccatgctaatcacagtactttagttatgtgaacaaagctaagctgcaagaagctctttttattttattttcttactgtgtcgacagcaaaaagttaataaagctgagctgcaacaggctcttttttattcaaaaaaaaaa

SEQ ID NO: 1846 - DNA, 2833 bp, Pinus radiata
attcaagatctttgtatttgtaagggagagtagcttaaagttcctaaggacgaagaatttttctttggaggcggattttagtgcggttagagtcgaaatcagcaaaatagcttaaaacttcttaggacaaagtaattttgctttggagaagaagaatataggggattaagcgttcacatatgtccgttgaagagatcagctaaaggctttgacctcgcatcaagaatttcaacaataatttactgttgaaacgcggttgtgcagtctaggcagtaaaagatcgggaataagcaattcaaggataattgaattgtcgaaaaaggttccaagccttctttctttcctgtgaaagaggatgattttcttccagaaaaattaacggaagagactataggcaatgcatttccggctttggccggagaaaatcagtggaggtgagaaaaatttgcagacaattcaattatggatactttcatggcgtcatcaacgtcatcagcggtagatcaggggttcagccaagaaacattgcagcagcgtctgcaaattctggtagagacggcctcaatagtgtggacttatgcgattttttggcaagtttcttatgattctagcggtgccattcaactatgctggggagacggctactacaaggggtcgaggaacgcagaagaggacgagaggcttaggatgcgcagccgtttgaccgtaagccccgccgaacaggagttgaggaaaaaggtgttacgcgacttacattctatgattagcgggagcgatgaagtaaaccagcaggataatagtggtgttagcgtagatgaagaagttactgatgctgaatggttctatttaatatcaatgatgcaatcctttttatcggggtttggggtacccggtatggcattttctagcggagctcctgtttggatcgtcggagcggagagactgcaggtatcaaactgcgacagagcaaggcaagcttatgaacttgggattcaaacgctggtctgcgttccaattcagggcggcgtggttgaatttggatcgacggaagtgattgttgaaaactggttgtttctggagcaggtcaacaattcgtttaaatgtaacctcaaccaaatgcatgataacccctttcaaatccagtctttatggccagctgaaactttgagtgtaaaaagcagcaatactatgcaatccgctcaatgcattgagccagtgagcaatcctgaaatccagtccatgaactctgctttagctcgggaattacctgtgacaggcaaacaaaaagcatctgtgttcgctgaacatagttctttagtggttacagacgacaaaccattgctgcaaactctaactcaggagaccgaagcctttgaagcgccggccatccatattgcagaaacagtaggaccacaaacccgcacattgggttttaaaggcagtgaaaagaacgagataaagccagcaataaaagaggatacaattggtttaccgtctaatccgcctggaattgttataggaggtctgcgatctagcattgaatcagagctgtctgatgtagaaccctctgcctcaattaaagattcaacgtctgctctagtcgagagaaaaccaaggaaacgtgggagaaaacctgcaaatggccgtgaagaacctctgaatcatgttgaggctgagcggcaaaggcgtgagaaattgaaccagaaattttatgagcttcgtgccgtggttcctaatgtatcaaaaatggacaaagcttctctgctcggcgatgctgctgcttatatcaaagatctcttttccaaacagcaggatttggagtccgagagggttgatatgcaggttcaaattgacactataaagaaggaattattgatgaattctttgaagttggcagctaaagaagcaaaagatctttcaagcattgaccttaaaggttttagccaggggaaattccccggcttgaattcagaagttcgcattgttggccgagaggcgataataagaattcagtgtactaaacataatcatcctgttgcgagactgatgatagcactgcaagaacttgacttggaagttctccatgcaagtatttctactgtgaaggattccttaattatccagacagtcattgttaaaatgaccagaggtttgtacacggaagaccaacttcacgccctgctttgtaagaaagtcgctgaatctccgaattaagtagtggaatatcactacaatattgagaattttcctttgaatgctgcaccgtgaattgtgtttcggaaaggaaatggtgatggtgtcctccaacaccatttttccaatgaaaacaccattttgtaacataattcaagattttttgtagaagcaaagggcaaggactgtgtacagtatcatagcttaatgttgctgatccaataaagcaacttgttctgacatgtattttattagaaaagtgacaaattacgatgcaaagagcattgtggtggtctttccaaaaaacagagttgtcttcaaaagggttattatgagataattccctcatctttatcatgcgaaaagaaactccagaaggccacattgttttaacaaggtggttttacaaaagagacattgagaacacaattcaaaagctaaaatgtcctttctctggactgttcgtttacagagcaggtaatcaactactcaaggattgttttagaatttgcattggtctcagcatgatgctgtatatattgtaggtgaggcgttttgttcacgattttaatgttctggtcagtgaccatgaaattgcctttcgaagaagttggaagtaagatagtttctaaaaaaaaaa

SEQ ID NO: 1847 - DNA, 2380 bp, Pinus radiata
tgtttgcgacattacaattagtattgggagtccattgttcctattgaagcaatttattaggttaatatgcaccggaaagcctgccgaggactcagtttggctgcctgatacaaagggggttcaacagtccaacatcttgacaaggctaagaagctcgaaggttaaagaactgcatgcaaactggctcctcttagccacgattcatttgtttgcatggaccaagttacagacggttctcattcagcccagcgcttgctttattctctgcagcaaccgcaagaacaacaatcagaggtcacattactgccagacaatcctgataacatgaatgcaatggatatgtgtatgctcgaccgacaaagaaaagggcctaatgcacagccgcagctgaattggccgcaacaacagcaattcttgagaacaaattctaattccgagcaaatccacggtccgtttatttcattgctaaagacttctgagatgctttctgacggcattattacaagcgaatggcagcaattggccgaacaaaatggacatttactgccggcaaatccagggtacgccatgaacttaggcggatcaatgtcgtgtcaagaatctgcgctccgacaaacgttaagtaggtcaatgtcctccccgaacggaccgctgaacttgcatactgactggtcaaatttatcgaataacacgaaaactatgtatggtgtggagaacgaggcaattggcagaagcgtactaaaagcgccggcatgtttgggtccgtttccttcggaccctggctttacagagcgagcggcgaaatactcgtctcttaacggcaaaaactggaacgcaagactgttaacaagtgagagagcatcagtcggagaaatggagaccagtagcttagaattcctttctgatgttgcccgaaacgaaccacaagtggcctgctctaacgattccgaaagcaagaaggcgttttgcagaacggcaagctgccctccgacggtcgaaaatgcggcagctgaaactgagaaatcgtcggtcctggttgaagaatctgccgtttctgaaaagtcatctgcaggggacattaagacttcaaataacaatgccgtaaagaagaggaaaagtggcaggaacagtgctcaaaaccacagggcggcagattccgaagagtccaaggagaagcgaaccaaagctgttcattccggcgacaaggagaaagaggacgtaatggcgaaaacagagcagtgtaacagtgacaattcagtggaattcagtccaaaacctgcaagagaaaatccaaaacctttggagaaccagaagcaagactacattcatgttagagctaggcgaggccaggcaaccgacagccatagcttagcagagagagttagaagagagaaaattagtgcacgcatgaaatatttgcaggacctggttcccgggtgcaataaagttacaggcagagcagtcatgctggatgaaatcataaattatgttcaatctcttcaacgacaagtagaattcttatcaatgaaattggcagccgttaatcccagcctggagttcaacatcgacaactttttggccagagagatgatgatgcctattcctcctcctggaaacttttcttcattggaaggaatgtctccaaatgcggctccctatatccatattcaccaaatgctgcagcagcagcagcagcaacagcaagcttcgttgcaagcaggagcatgtactggattggatgtgcctacgctagatacttcaacatcactgcatagacccggttctgcagaaatgtttgcagatgctgccaatttccaggggcatgcaccttctacttgggatagcgagctgcaaaatgtctttagcatgggtttagttcaagacaggcagcctccatttccatctgaaggacttcctggtcatttggaaccaaaccatatgaaaatggaaatgtaagagtggtagatgccctgcattcagatacattaatcatgttccccaaattgaggttgcatgcactgattcaggaggaggaggaggacaagacaactcgatgcaactttctagtagctagctagctgattctttgctaatctatggatatctacaccgcttctctctaattctatagttcgactcttaatgcgctttctcattaaagactgagaatagctcccaaggctctgactaaataattactacaagtaattaagttcttattattatatagcaccagggatgtacatagatttagcttctctagcctggtaatagtaatttgcaggcggactactcgccacattctttagagtgtatccctctgagctttaaaggagaatctgtctgctccaaagctcagtaggtattgtacacttattta

SEQ ID NO: 1848 - DNA, 1920 bp, Pinus radiata
cagcagtggtgaattgcaaattaaagttgtgtaggcatcttgtgtgaattgggctcttgctgcagctgtaacgcataataattctgagctactttttgtgacgtctgtgaacaatttattgaagccgtgttttctgaatgacacctcctgcattttaaaccccagcagacctgatacggagatcagtccagtttccttaagctttcacatccatccattcacagcacgtgcaattctatgctgtcaatggcacacctgtacatctctgcacgtcttttcccatacgtttatcttctcatcatcttctgattccactgattactcctccaacttccaagtcaagtccttcatctccagatctgatctgctgcctgcaccagtcattgtgccctttcctgtgtcccatgattaatgtccttccagatcttcacggagcaatcaatccagttctgataggcctttctacccccattttctcctggatctgagcctctcactgtgtatgggcattgggttttgaattacagtttctgtaattggtttggagagtgtctgttcatggattcaaaaatgtttcagttggaccagatggatcaatttgggcttgagcctgctgatatgaatacattcaatatgactgcagtcagccctgaggaattgttgcagcttgactctgcctgcccatcactgtttggtgggttgatgcagtttgattctaacaacaagcacaacaattcagactcctccccctgtcaatctcctgatggtcctgtattccctgcatttgaagggttgaatttttgcaacaacctgagcattaatacaaattatgtgttgcagagaggtaatgcagcaggttcatgtgacagcattaacgatactgataccaacagcaacatctcacctgcaggctctgaagatctcagaaagtcaaatagctgcaacagcagtgaagccacccaagaccacaagaaagtggccaatcttgatcttgttcttgatcttgatcttgatatgccagctgttcatgcagcacctgccatggcacaggtgcagcccaggtttaattacttcccaaggttgcagggctccatgaataccgaccctgctcctcataatgaggggaataataacggcatgggagctatgagggaaatgattttcagagtggcagccatgcagccaattcagatagatcctgagagcatcaagcgccccaagcgcaggaacgtgagaatatccaaggatcctcagagcgtggctgctcggcataggagggaaagaataagtgagaggatcagaattctgcagagactggtccccggtggcactaagatggacactgcctccatgctggacgaagctgttcactatgtcaagttcttgaagaagcaagtgcaggctctggaacgagctcatcatgccaaagctcctgcatgctggacgtccaacagcttcagtcagggtgccctgataaaccctgcaaatatctcaaatctcaatttctctgcattcaattccatgaccaaccctaacttatctaatggcctgcagttcagtgctgtaacttcaaacaccatcatgcctctggatcgctcaggcgtatcatagaattgaatgtttgtttaggcaataagagacgtgtttaaaaattacaaaaaattattgatggctttgatatatttatgtcaaacctcaactgtgatatcaagcttcactgtaacttgtatattatgtatcaacattgttagatatgcatgtgataacattgaacgtactgctctattcctccatggcaagcagttgtggttccaccattgaaattttctcttgggtgggttcctaggtgcatgaataaatcagagcccgttctcttcgttttctactttgtaagacattacatttgttattgaaatggaa

SEQ ID NO: 1849 - DNA, 1830 bp, Pinus radiata
gggattcagaccatggtatgtattccaactcctaatggcgttgtggaattgggttctatggatctggtctgtgagaactgggctctgctgcagcaggccaagaactcctttactttttcctctaatccctgggaagataacgggaatggtaattttagtaataacaataatcataataataattatggtaccaataaccagtcgttatgggttccaggatctccatttttgacccaggaatcgatactgggtgacttgagttttctcaataacgaggaaaaccataatcggaattcgtctgctcaaaaacccccgtccatgatagaagaaaaccgaaaccctctacccccttttactgctcagaagcaagtagccatggaggaaaaccgggttccactctctttccctactcagaaatccgctgtccttgacgagagaacctcctttaatcttgttcagaaaagtggcatctctgaagcagctcataatcccctgccatttcttccgaagccgcctcctgtaggcggctttgatgagaagtctaatcctatggcatattccactgttccaaagcctgctattattgatgagaactgtagttctttgctttctcagaaatccagcatctgcagtgagattcttaatcctttcccatatgtggctggtccaaaatctatagatttcagcgaaagttgtaattcttatacagttccatctcttcagaaaacgagtattgaaagcagcaaccagaatacgctacagtctgccgctgttcagaaacccaacatagccgaccaaaatggtaatccaaatccaaacccaaatcagctgcttttttctgttcagaaaacttgtgtcagtgatcaaagcaaggcattcagcagagatctcctgctagaggacgacaagcccaagcccttgttgaatatccagaataacaattcccagagacacactctgagcttttcaaatggatactcgcagaatctcgtggaggagaagatggtgaaacccctcagtattgatgatgaaaagccaaattcattgcctacgatttcctctggtgctgtctttggtggagttcgatccagtgttgagtctgaccattctgatgtagaagctgcttcctttaaggaagcaaaccaagctgtcattgagaaaaggccccggaaaagaggaagaaagcctgcaaatggtagagaagagcctctgaatcatgttgaagctgagcgtcaacggcgtgagaaactgaaccagagattctatgcacttcgtgctgtggtaccaaatgtgtccaagatggataaagcttcattacttggggatgccgtggcctatattaatgaacttcaaagcagagttcaagagattgaagctgagaaaaaggagcttcaagcccaaatagaagttaccaagaaggaatcctcgtcttctcactctgctttctctggtaccaatttgggattcatcaaggaccagtctggttcatctcaaaagcctgatgtcaaaagatttggcacaaaggaatgttctgcgatagatttggaagttcgaatccttggtccagaagccatgatcagaattcagtctgctaagaagaatcatccggcagccagattgatgacatcactgcaagacctagagcttgaagttcatcatgctagtgtctcaacagtggacgagttaatgcttcaaaacgtgattgtcaagttaccaagtagtttatatccagaagaacagctcaatgccgttctcttgaagaaattatcagatccaaaatttaagtaactagagagctggatgcttattttgatattgtcaaaaaaaaaa

SEQ ID NO: 1850 - DNA, 2700 bp, Pinus radiata
ggcgactgtgtgtccaccatcctcgttgcatcccggccctgttcgatcctcagatctctcgtgctcagttgcattaaattctagttttggttttccttttcaagatttcataacgcaaagagtaccgcctcctaatagccattgcatggagcttccccaacctcagcttcctttcgaaggttcgaaaccgcctcacgactttctttcattgtatggtgactcctcttcaaaccgcgtggaacacagatctagccaagcaaattccacgcacctgaagacgcaggattttttacaacctctggaaaggggcggcaaaaatagcaatacgaaaggtctggaggtttcatccgccgagacctccgctgcaactcctgcctcttccgttgagcatgttcttcccggcggtatcggtacttacactataagccacatttcgggttacagccagatgaacggtaagtctgagattcctgtggtccacgtaaacgttgcagaaacaaaaccagaagtgaccagggctgcctcgagcaccaattacggaggaggcgcattcacattgtgggaagaacgccttcgtgttgtggacgggaatcgaacctccgacggtccggctacaagtgatttcagcaaagaatatctggagaaatcggggtattggccggccgttagggcaaaggcagacttgtcctttcctgcaaagactgcttttagccttagctcggtggagaccagtcagcagcagctgccttcttcaagcaagcaacggctgcagacaggcccaggttttgttgagatgataaagtctataaaaaccatctccgaagatgacgaagatgaggaggatgaatatgtggatcggagtcgcgaggggcgaaaggaaggttcatctcagaaaggtgacccgccaccaaaggctgatgggagaagcagtgatcagaaagccaacactcctagatccaagcattctgcaactgaacagcgcaggaggagcaagatcaatgatagatttcagatgctgagggatttagtgccaaatagtgatcaaaagagagacaaagcatcctttcttcttgaggttatcgaatacatccaagttttgcaggaaaaggtccgaaagtatgaaacaacagagcagagctggaatcaggaaaggatgaaaactatggtctgggacctgtgcaagaaaagcccagggcacggagaagtgcctgtggatggttctcgaattggtgttggcattccttcagattcgaaacaaaacaatgaagttggcgatccagctagatccaaagttacttcgaatgcattgcgttatgaaaatggtactgctggtgcagatgtgcacccaacttcacagaatctgttgcagcctaataagcctactcctgttattcctggctgtgccccttcttacaaagagaaggaaaatattggtgctttcaacaagtcaattcctccaactctttccatgcaacagtgtgtgtactctccttttggcaggagttatatacattccgcaaatccgaaggggcaggcaacatctgaaattcattctttacagggtattcagggtatgactcctatgtgcattccagcaaatgcatacaattttgataaagagaaagatgtcgacactgccacacctgtccagctgtctcattttcaaggaaatactgttactgtggcaaaaactactagtgggcatgaaagtcagtggtctgagctaaggtcatctcaggtgtcaccaattcaacaatattcaggccagaatggagggatattgctcaaagatgaagctgcagatacaaaatcagcatctaagtcagaaaatcagcattcaagtgcatatttaaatagctctccaaggttatctcagtatgtgcctcaatcagaagctgaactagcaagtaggcaaccacaaccaccttgctcttctcctgaccaacagagggcaagtgaggctcgaccggctactagtgaacaggaagaacttgtgatccaaggtggtgtcataaatgtttcgagtgtttactctcaagggttgttggatacattaacgcaagcattgcagaactcagggttagatctttcacaagcaaacatatcagtgcagattgaccttggccgccggggtggaacatctggaactacaactaatatcaaggagcacagtcacaatcatgaggagtcgtcccagaaccatcaattacatgggcagtcaagggctgcagagacatcctccgagtgtgagcagccgccgaaaaggcctaagattgagagagatgtttagctaagcctattctttggattatgcatatcgaagctgtacgaggcctccatccagcccgaatgtaggctagaagcaaattccaggattgtggttgcttagtttccattgctgggaacagtagacattattaaagagggaaattagcaggtcgtaggttgttttaacattcacctctccaattcaattactgagaggaatcaacagtcgccataataaggattaaggattacatgtacctctcacgtgtcaggaagagttttctctgcaagctggaaagcttggcatgtatttttagatgacatgtacagattttttatggcattggttggttttggtctgttatagaccttttaaatgttgtaaatattattttatgaataattcataggttaatccgcggaaaaaaaaaa

SEQ ID NO: 1851 - DNA, 1966 bp, Pinus radiata
ccttcgtcttcgagagccaaacccagggggatcgcagcaaatcagagcagaaaaacaagaagcagccgaagatgctcgaaagaagcgggtcattgaacatccatctagccgcgccgcaagaacggctgcgttctctcgttggccccaagcgctgggattatgtcatctattggaagctgagcgatgatcaacgatgtctagactggacgggatgctgttgcagtggggctgatcagtctgggcaaggattgcaaaatcctagccctgagtcgcaccttttcttctcacctcgttattttgaaggaggcagttgccgggacgtgatgtttcagcatcctaaatgtactacatgcgaaatattggcagactttcctacttcaattccactagactctgggattcaaggacaggtgttcttatcaggacaaccgcggtggatgaactttccaaatattggagatcccgatgccggacaggaagcagtgcaaactcaagtgctcattcccgtccgcaacggtattgtagagctcttcgtttcgaaacctgtcgcagagaacgcagctcttatgcagtttgtattcacgcagtgcgatccgtggcttcctcagatgtatgatacgaataatttattcggtgcttcacctgctccaagcctcggtggctgtggctttggatccgtaagcgaagctgccggtactctaccatggctccctgcagctacaggagattcttctgtaccttgggacgcagaaagggctttatcagagtcgcaactgtctattcacatggtcacgccgcatctcaatttcctcgggcaacaattgcagccacaagtggcggcctctggccaaattaagcagaagaacgacttctatgaaggatctgccgattccattaatcatgcggaaaagccacccgccatgcatatggatccagtttctctgcaagacattcaacaggcaggcttaccgatgaggaacaattcactacctcgcgggcatggcctcactgaatcccctcatacgagtggtttgtcgaaagaggttcaggataaagatgtcaagcaagagatctcacgagcagactcttcagactgcaccgatcaaatggaggacgacgatgaccagaaagctgcgggccgatctggcagaagacatctctccaagaacttggtagctgaacgcaagcggaggaaaaagctcaacgaaaggctctatgctttacgtgcattggttcccaagatcaccaagatggacagggcctcaatattaggggatgctattgagtatatcaaggaactgcagcagcaggtgaaggaactccaagaagagttggatgaaattgacgttcaagcgggaaaccctacaactccgcctaatttggaaaatggtggtcaaacaaccctagatgaagaaacccatgcgagatgcgctgctaagacagatctgacaaaaggtccaggaaatgcaactgaagaaacagttcaaactatgcagatcgacgtgaaccaggttgatgcacatgttttcaacctgagaatattcagtgaaaagagagtgggtggttttgttaaattaatgcaagcaatggacgcactgggtctcgatattctaaacgccaatatcacttcctacagaggcctggtcttgaatgttttcaatgcggagttaagggataaggaagtagtacaagcaggagcggcgcaattgagagactcgcttctggagatgacattgcacccagacatccttcgaacaggtgagggcactgctgcttcagatcatcagcaacgtcacatccaacagactacctgaaccataaaccatgttcaagagctttaaccctttaaaatgtgtgcttgttttttccggttaattattccatagaaaaggaatctctattctcacttcttcatgtaacctgcactgcctagcctataatatatttattctattgaaaaaaaaaa

SEQ ID NO: 1852 - DNA, 1127 bp, Pinus radiata
caaaatttaccccagtttcaaataacctcttgtaaggattgaatgacctctaacatgagcgacccttcttggttgcactcaccctttttcccctataacgatgatgggaacaagtttgatgtcgaaagcgtatcgagtaattccaatccatttctatcgatttataatgctgatcatcatgcccacggattcaattcctccgagagccacaaatccgaaaccctagccgtcctttcgaatcctcctctcttgcaaacaatctgcaattccagtcccccaagtgatggtcaggcttgcactagattaccaggctctgtcccggcgggaaaaaataatcacaaaatgattgaaagacagcggcgtaaagaaatgaaagtactcttttcacggctgagatcattgcttccagaagaaaatatccgtggaaaacgagcagcgtcagaacagttactggaagctgtgaattacgttcgctatctgcagcaaaaaatcgaagacctttcagcccaaagagacaagcagaaggtcaactctgatcaaaatgcaaaagtctcattcaggaaattttgcaataaaactcagccgttcggaggatcggatcgggaatgccctgcagtgaatataaaatctgtgggttcgggtgttcagatctggacgaactgcttggagcatgagattgtgtactctgagattttattagcgctggaagatggtgggcttgaagttgtaagtgcttcttcatctgccgttaaaaacagagtctatcatacaatacatgccaaggtgtttgatcacagtacttttaacatcgaaaacctctaccagaagctttggcatttgataaatgcccaccacaacaaaaatcaggatctaaggatcactgaagctcgggcataatgttttatacggcatgaatgaatgctcaaaaagttctgtcaatcttacattatgcatctatcttaaactgaataacttatttgtcagaaacggttgttgatgaacagaatcacagagattttaggaatgtatatcgagtgatcgactagtccaagtttgtcagagatgctttgtggctaatataaatcacagactggaatacctatttaagttatagaataaaaaaaaaa

SEQ ID NO: 1853 - DNA, 2215 bp, Pinus radiata
cagagtgttggaatcgaggtttttatgaatgccgagggtttgatccgtttcgaaaattccagccaacgctgttgtagcggagactccgagagacggaaggaaaagaaaagaagctcgaagagtttagaacgaagaggtcgataaagaactggaagtggagcgaagggagaaaaagttcaggatggtgttaaacaaaggaaagcagtaaagtttaaacattcaaagcaaggggtcatcaccttgcaatcaatgctgcaattggcaacagagtagaactttgtaattacaaagattgcaatgatcatgtattttgttggctgtttggatgaaggcgctgcatgattacattgtgatcaagatgcatggaaatctgccaaatcgagtggggagaagggagtttcttcagcattagccccgtcgtggtgtaatggttgaagttactatatgcaactgatatcattattcaattctgtaagctgcatattggagccctgagatatgatgatgtcagttttctagattcagcatcattttgcttctcggttttctatgtcatatgtcaaaatgctaaactctcgagctcagcccattagcactggtttaagcattccatctctgagtgttggacatactgatgtaaatggaatccaaatatcgttctcccagtaccccatggactcagagaagatgcctcagatgcagcaacagacaaataatgtagactttatggacctcgattataagccccctctttgcaatgtttcccaagcagatggagtaatggcattaacagaaagaggttcgtccaacaattttcagggaccaacaggattgatgcgctaccattcggcgcccagctcatttttttcaagtctaggagaagaggaaaataataacattatatcagagtatttctctggtaattcttcgaatccactgcaatcaaataccaaaccactgcagcaaaatcaatctagtatattgagttttcatctcagggaaaatgaaccagcaaagcatcttggcgaacgcaatgaatatctgaaaagaaatgcacgccagctcccttccctcaaaagaagtgcagggaatgtttctagagaagatctaggcaagcaccatcctcttgatgcaatccttgagaatgtaccggatgtatcccaagacagttttggcacctctcaaatgtcattgatgagccaagttcaagtttctgaaccaagtggacaacacatcgattcatcctaccaaatgaattcagtttgctgcgatacccttgatcagtcaggaggaaggatgggcaatgcatactcctcaacatccaagaatacacttattcgacatagtagctccccagctgggctactctctgaactagttgctgaaggccgaggtacttttgaaagtggaatgcaaaatggggctaactttacagcaagaaagcgtgcaaaagaattggatatgaaattaatgcaaggcttgaataactcagatcaccagaaggtagaagcaggaattcgaggtgcatctgcattaacaaatcatccatacaatctgccaagatccacatcttcagaacttgcaatggaagaattcctgcaagatgctgttccatgcaaggtccgggcaaaaagaggctgtgcaacgcacccacggagcatcgctgaaagggttcgaagaacacgaatcagtgaaagaatgagaaaactgcaggaactcgtgccaaacagtgacaagcaaacagtaaatattgccgacatgttagatgaggccgttgaatatgtcaagtctcttcagaagcaggtccaggaacttgcggaaaatcgagccaagtgtacctgcacacataatccggattgtgcatacaaaacataatcttattgtgaatatacaatcctaagcacctgatgtaaaagatatttaatactgttctcaaatatatcttcttcttggcacaggccctttcccttgtgagtgcttaggtatatattctgtcttgatctgacattggagcctagtcagaaatgtaatatgtgcattatgtaatactgtggggcaaatcctatacaacctcttattttggaaatacattgtaggattagcttcatgcttaagaaacgacagtcattatcagtgcttggtaatggggtctttatcttaattggcgcttattagaaatattttagtctgcaaaaaaaaaaaaaaaaaaaaaaaa

SEQ ID NO: 1854 - DNA, 1281 bp, Pinus radiata
ctatgctatccttatagtgcttccgttttatcgctgaatatacttctcattttcaccattgctgcctattgtgaaaacgttgtaccatttgggtttcgttgaaaaaatcccaaaattttctgtctgaaatcacttggggtttaatacctttcctgtttgctgttgaattgggtatatggtgtcatctccatccaaaattgattcatcactggcaaaaagggctctgcaataaagcaagagtagcaattttttcatttttggagcaagcagtgattatcaggaaaggatctgaaaggtttgttcctgtttcaatctctttaacagctctgcagtcaaatcagattcttgtttctcattcaaaccaaatgggcatcgacaaaaactctgtagtcccaatccagccattacaattcagcagagaagtatatcatatgggtagtacccaatatgacaatatgaacttttctgctaatctgaatgctcctggggctaaaactgcagtgtccacaaagaaatcagtgcccatgtctgaggacaagagttgcccaattcaggattcgttgcatcaccatagaggcaatggggagggcatttcacattcttggagcatttcagcctgtgctgcagcagaggatcagcaagtgatagacgcgaaaaagcaaaaaaggatgttgtctaacagagaatctgcaaggaggtctcggctccggaaacaacttcgcttgaacgagctgaacgctcaggtggcctatctgaaagcggagaatgggcagatacagaacaaattaaacattgcttcgcagcagtatgctcagattacagaagagaattacctcttgaaaatagaagcagtaaagctgagtcacgagttccagggattacactacataataactgcccaatctggtagtgcctataaaaccatgagtattgaaactgggaattgcagtgctgcacatctgagctccgaatcagggatcattcctaacagttttacgtctcctgatttcttgttttgaggaccaaaagcaatatatatttttgggagtaacgctaaaccgtttttgggattctgttaggttgtatgttgttttcttcttacaaggtggattttgactaaattgtcgagtggcgttttgcatatgtggaaacaagttcgatttggccacatttattgtcttgtagtggggtaatgggaaaccatgtctcccccccttaactcggatcgtagttgcggtttcgatttataaaagtgatgggcatttagttttaaaaaaaaaa

SEQ ID NO: 1855 - DNA, 2373 bp, Pinus radiata; identical to SEQ ID NO: 517

SEQ ID NO: 1856 - DNA, 1844 bp, Pinus radiata
ccgccatccagatatgttggctacccttccactacaaatgctttcactgtaaaacgagacccatctccaggcccttccccatcttcaggcccatccctatcatctgccccttcagtgtcgtcgatgagatccagtgcttctcactctgttgatatccaaatgcaagactctgcatcttctcctgttcccaagagtctccctagcaatacccaactgtccaccatgtcccctcatcatttcagtactgatgtcaacaggatgccagatattcctcctcggaaccgaggacatcgcagggcacattctgagattgcggtgcgcttgcctgatgatataagctttgaccgtgagcttggtgttgttggttcagattgccctaccctttccgatgaagctgatgatgatctcttctcaatgtacattgatatggataaatttaccggattctcaacatcttcaactcaagcaatggcagcaacaacacagtctggttcagaaggaggcttaacaccgccctttcaacccactcatcattctcgaagtgtatctatggatggagtgttttcaggttttcaaaacaacaacggcggttcggccccaggtggtattacttctgataagcctcgagctcgtcatcaacacagtcagtccatggatgggtttccttccatcaagcctgaacttcttttatctactgctgaggcatctttagcagaaacaaagaaagcaatgtcagctgccaaactagctgatcttgcacttattgatcccaaaagggctaagagaatttgggcaaatcgtcaatcagcagcgaggtccaaagagcgaaagatgaggtacatatcagaattagaaaggaaagtgcaaactttacaaactgaagctactaccttgtctgcacagttgaccatgttacaaagagatacaactggattgacaaatgaaaatagtgaattaaagctacgattacaatctatggagcaacaggttcacctccgcgatgctttgaatgatgctctcagagaggaagtacaaaggttgaagctggcaacagggcaaggactcaccagtggtggacatctgatgaattattgcaattcttcttttacctctagtcaacctttcttccagaccccacttcaatcttcacacacttatttggctgcacaacaacttcaacaacttcatttgcagtcacagcaatcagctttgaacttacggaatggggggactggatcctcacaaggacatagggacaacctctctgagttcagcatgacagctgaaggattacctgtttccacgagtcaggaagctggctgtaacttttgaagctatatggttgaatacttgagatattatcaggaatggggtgctgagtttagcaataagattcttttggaaattctttgaaccagttcaaatattttagtatatagagcaggcctctaatgagttagcctgctttagatatttgttttgtgatgttaaactttgatttattggtcatccttcatggaaattctttatgtgtggctgtttatccatgttcatcacatttagggttgaagttttgggtatttagatcattaagttatcatttagaaaaggggtgcttagtgacactatttaagattttttgggccagattgtggacatgtgatgaaaattgtgatttgtcatagtcttgcatgacaaattatagttttgtgtggcatctatttttgatgcgtttgttctctgaagttccagccattgcctgatatagttctagtcttaaagcctcagtttaaacttgcaagtaattatgaagaattgctttggtgtattccttaaaaaaaaaa

SEQ ID NO: 1857 - DNA, 2706 bp, Pinus radiata
tttacatatactcacatgcaaatgggcttaatttaatagactgttgaattctttaattgacttttgaaaccctcagaaattgtttcagattttatgatggaggtgaactaaaggtctgccgctggatttcccccctacccaaatgaagaaattttgttgggtgtcccataggtgaagaatattaggttaattggttaatcgttaccccgagagccaggagaaagtgtgtgttcgaatggaagggttaggggatggttacgaggcattcgtagggcgtttgaagatggacatggccacaagcaacgcaccgaagaccgctacagggaattcactcagtaatccttctcagtcacagcaattgcagcaagctaggtatgtaggttacccatcttctaccaatgcatttacagtgactagggaagcaaagccagctttatcggattcttcggggaattcagtggccatggatgtgactatgcaagaacctgtgagctcgtctggtactgtcggcgttacagagccctcagggaatctaggtcattcacagaattttagtactgatgtcaataggatgccggatgttccaccccggagaggaggccatcgcagggctcagtcggaaattgcgtttcgcttgccggacgatatcatgtttgatggtgatcttggttttgctggttttgacatgcccacggtctctgatgacgcaactgaggccgaagatctgatttccatgtacatggatatggagaaattaacttcttttggagagccgttgaattctgcggcgggagaaggatcgaagctcccctcgggtgctgagactaatcgacctccgcatcattcaagaagtctttctgtcgatgctgtattttctggattcgaaggtaacatggaagatacgaaagggaaccttggtactatggggcctagtcggcctcgtcatcgtcatagcaattccatggatggttcatcttcctcgcaattaaatcaactgtcgtcagagtctttagagtccaagaaggcgatggcagcaaaaaaactccaagaactagcacttattgatccaaaacgagccaagaggatattggcgaatcgacaatcagctgtacgatcaaaagaaagaaagatgcgttatatatcagagttagaacgaagagttcaaacactgcagacggaagcaactactctttcagctcagcttacattgttgcagagagatacaacaggactaaccaccgagaacaatgaactgaaactgcgactgcaggctatggagcaacaagcacaacttcgggatgctttgaatgaggctttgagagaaaaagtacaaaggctgaagattgctactggccaactttcatcaaacaatacaaatgccttcaacatgtctgcaactgcacaacaattgccattgaatcgatcatttttccctccaacccaacattcacatcgtttgaatcaacaatttcagccatttcagcattccgcatctccaatgaataatcagccattaatggggcagtctcaggtgcatcagaactttccccagtatggtcctgcaggccaattgcaagtgcttgtgggcagtcaaggtgggcctgctgtagaatcagaagtgtcctctagttctgttaaccatcctggtagttctgcgttttagatggagagaatttgtggaagtgacacggtattaatcagtaagtggagttctggctttatcagtggccaagatggctgttctcatgaaaatccttgtgcgtttacggtctttgttttgattgttacacccaaattgactgcacctgttcttatcattcaaagtaaaagttgtaaaatcatttggtccatcgccagatccctcagaaaagctttaatacatttcagctgtcttcatgctgtaatggacaacaagactattatatgtcatgtaggttggcaaatgggcatgcttacctgtagctgatggagcatgccatctttctacttcgagtcttgctttctgtttatgagcctggagtatgtatttcatttttttagtgtaaccatggcttagcccatcaatagtcgacgccttcgcattaaccagtgccaattattattgcttagattactagatcctttaatgcttcatgctattctgcccccaatcaataagcaccgcatggttttctcagcacacgagcagttgtggaagtaggcatattcttttaggacaacttgataataatagctaatattcttttagaactgcccaacaatattgtacttgaagttgtggcattgagtcagttcatcctatcatctgggatctccttcagccacatggtaaagataaaaaattgggtgtcttcggtgggcaggcatgcttgaacgatggaaaaggtacatgatagtggctgttatcaatgtacaaaagttggcaactgcaggttcatatcctagtgtatgatattcgtttttgtgtgctacttctcttaattaagttctgctttcctcttcaggagagggtaaatcgaggaggaaaggctatgattatgatattgccattagatgttgacacctcttgtcaaaactctgaaacagtatgtttttaggttttctccacaaattgaaaaatcttgtaaccaaattgctataggtaagtgtttatgtatagttattgttctaagcaatgaacttggccaaactgccttaaaaaaaaaa

SEQ ID NO: 1858 - DNA, 1898 bp, Pinus radiata
gtgggacagattttgactattgggacgaagcatcgagacttttaggcgtgtatggagtgttttttaattagactgagctgcacgcttcactgttttaggttttgggagagacagaaatgcagaatatcaggtacaaacttaaaatccaagttaggagaagaattcaattaatatgccaattgaacaattgaatagaacctgaaccagacactttctcaaataacagcttctaggtagttatgaagaaaaccaactatcataggtctgaataatccccaaaactatggaagtacttgcaatttattcaatatttgggtaagtttttagtacccaaccaatggtgaagattgggaaacggtctagccttcatctgtgagcattatccagattgtaaccaatggcaagccagagagatggtgataactcaggtgggaacaggggacaaaaaacaaatcttccccaaccagtgctcaagaacccgccatttcataccattggatccaatgttgtagattctaattgcaattccttcaaaggttggtctgatttccccttccctaataacaattcaaagcatcagttcttcccctcagtgggatatcttgcacattttcagccaccatggaatgatgatctgataaagtctcccttggaatccccaacaaagaagacttcccatcgacgatctgccagtgattcgctgccctttcttgaagccccaaccgattgttttgctgatggtgatgagttggattgtaggcaggatgtgtctcttccattaacagaatctatggactccgaaaatttggaggaaatacagccgatgtcaatattctctgacgttgaagctttccaaaagcaaaaggatcaagcagatggatcgactgttaccgctccatctatttctggtagccttgtctccctatcagatcataatagcttcaaggaccctctgatgttggagtcaaaactgaatgcatccagtcagtttcgaagtgagccagaagatgccagcatctgcaaaggagagcaagatgatcagccagtaaagattgaatggagtgaaacaacgccccctgatctgaaagtggataaaaaaaggatcaagaggattattgccaacagacagtccgcacaaagatcacgtataaggaagctgcattacatttcagaactggaagaaagtgtcactgcattggaggtggaagtctcaactctgtctcctcaggttgcctttcttgaccaccgacgagccaaattgaacattgataacagcatattaaaggaaagaattgctgctcttgtacaggagaagattttcaaggatgaacatagtgaagcacttaaaacagagcttcaaaggctagaacaactatatcagcagcagcagcaaatgcagtgcagacagcaacggctagaacacgcaatttcttcaaatgctgcatttgatttccaacaacattaattgggcgaggttgagattagtccattgctcagagggagctaaaggatgatatcttagattcttcagcttggcatttcgaagagccatgcatggaattttgacagaaaacatggtgtttctaatggagctttccggtcctcagacactgaaaggcttgaaggtgaccagcaaccacatgattagcgggtgagactcgagaagaggatgaacttgaagggcataatgattgcaagaaatgcgtccatgggccatccgaggacatggtttataacccataggttatgcattgaaaaaatttcaacagagtttcctgattgtttgcctttctggacattgctatgatttcactgtgaataatgtttgtcaaacatcttttgtaagagatataacccttctccataatttatatctttggcattttgcaaaaaaaaaa

SEQ ID NO: 1859 - DNA, 1742 bp, Pinus radiata
gagagaactatctgttttttcggtttttacgtgacttgtcagtctcttgtttgtaatgcacatatatattgagtgacagtcgagtgcgtattgattgccaatggctcaccatggggcgagtgataattctgctgccaattggggatacacatcatcgtcgtcaaaactgccacagctccctcccaagagtccctctttcgggattgttggtcaagattccagtaacaacaatattatgtatatgggttggcctaatttctccttccaaggcaatagtttgaaacatcagcgcacaccctcagtgggctatctgtcgtcgcatggccagcctccatggatggatgatctgctggactcaccctctgaaaatccggcaaagaagggtccccaccatagacgatctgcaagtgattcgcttgctttccttgaaaatcctgtggcttctgctccaatagaggagattgcagaggaagatgaattcgattgcaggagtgctgcatccataccgtccaaaggatcccaagacttcgatagattggacgaggaccagctcatgtcaatgtttgctgacattgaaccattccacaaacagcaaaatcagtcaaatcaaccagtttctaataatcctcatgctgcactatcaactgctttggataacagatgttcagaaagacagacaatttctgagaacccttcaacaccatccgaccacaatagtataaatgagacctctatggaggagaaagtcatgactgtgtcaggtcagttcaaaagtgagccagaagttcaaagcgtttgcaaaagtgagcaaccactccagcaaccagtgaagattgaaatgcccacatcgtcatcaacaatggagctcgacccaaacattgatccaaaaagggtgaaacgaattttagccaatagacaatctgcacaaagatcccgagtaaggaagttgcagtatatttcagagctcgaaagaagtgtcaatgcattacagacagaagtgtcaacactgtctcctcaggtggcctatctggatcatcaacgagtcttgttgaatgtagacaacggtagcttaaaacaaagaattgcagcccttgcacaagacaaacttttcaaggatgctcattgtgaagcattgaaaaaggaagttcaaaggctaagacaattatatcaggaacagcagcaacaaaatatgcagaaagaagtagcagcaccctcaacaggatcatatgacttgcaacagcagcagtttggcaagcttgagcacaattcatccccacagatgatggaacaaaagactgatcatgtttctgattcttcatcaaatcttctgaaaagtggtccaggtatctcagaccatagagaaaacaatgctgccaacaaccataccagttctggttctcaaatgttgaagggaataatgacttcgagctgccttatgggtgatggtaacaagtgtttggaagaaagaatgatgggaggaatgtcttctgattacatggttcacaacacttaagtgcaacactactgcaggtttttattttgggatgcttgtggttatggagtatgaactaagtattcttaccattttttcttctgtgttttgtttgacccctctcagccctgtattggaattgtttctgaataacttttgcttagacacattttttgtagcagagggccgctacccttctgaataaaatagattttatcatttatctaactacagttgtgcaaaaaaaaaa

SEQ ID NO: 1860 - DNA, 1392 bp, Pinus radiata
agggacaaacataaccctcttcgattgctttcctgtggcgattgcagctttaggattaccacccaagatcccgacagtgtttctgaattagtttcccttggagacaggtcaataacaccatgtcggatgacgcgggttctccaataattaaagatttcgagggcgatcttgggtgtgatgatcatgaccaacttaaggattggctgcactgggatttcactgacgagggtttcatcttggaagacctcatcccatgtggagaggatgatgcttgtgatctcggcgcctcggcagtccatgcaaatgctaaagggttttgttcagattttggcgatttcgaggatttgtttgtaaattcttcttcctcagcttccccaaacaacaacagcgatgcagtggatgtgaattgtcacggcccccgaactaccgagggaaccgcccttgtgaatggctatagtgtcgataacaaagagtcgcagagttcgattcacggtttggttcctgagacccgggcccatggggtccaggatcataaaatcgtcgaatccaagcgccaattaagacttatcaataaccgagaagctgcatttcaatcacggcaaaggaggaaatcctacattcaaggtcttgaatccaagtgcaagatgtgggagaattattgtaatcaacttcaaggatcaattgcctttgtctgcactgaaaatacagttttgagagatgagctttcccgttgcaagagccagaagggtagtaatggtgtgtcggagcctgcagtgctaaaagattccccgccgttggagtcccgatctcatcttaccaccctagtggttgctggccatataatcggtgtccactgcctcgaatggcttctggcagcactgaccattctacttctagtaggggcagtcaatccaagaagcgtaaacagcacaagtcaagctgaggatgagtataagtcttcaattttcagggtctcaagtacttttggtgagaaaagaccagttcttgaagccttcccagtcacaagtagcaaagcattatcctcttgtcgtcatcattattggagattaaaggagtttctttttctctcgttgttccatctatcatagttataattatacaagagcagagatcatcgcctacatcatgttgttgtcaagtttaaggagttttttccaaccatttctgtgtgtcttatagcaaagttgtagctgtacaggtaggtagcagagcgcgttagttctacagtaaacattgtagcaaatgtgaaacacagttatgctttctgccatgagtttttagtaattactaacgaaattctatcgaacttcttgattctccaaattaatatttgatgccaatgggaatttcctaaaagctttaaaaaaaaaa

SEQ ID NO: 1861 - DNA, 1542 bp, Pinus radiata
gagcccaagccaatcccttgtatagtatcaaaacatagtagaacagataccagggtctagctatagcaaacagatatcagggtctagctatagcaaacagatatcagggtgttgtacagaaatagatgaagatgaaggtccagtgtgatgtctgtgaaaaagcagaggccactttcctgtgttgtgctgatgaggctgctctctgttcagcctgtgacaataatgtccacgctgccaacaaattagctagcaaacatcagagagtatccctcatcaacccttcttctcagtcgcccaaatgtgacatttgccaggagaagacgggatattttttctgtctggaagaccgagctcttctttgccggcaatgcgatgtttcaatacattctcttaacaatcttgtagctgcccatcagagatttctagtgacaggggttaaggttggccttgaaccctcgaacaccatttctccttccacaaaaacttctacacagtcgtctgatatcaccaacaaaaaaccacaaaccttgagaaatggtccaacggaagtctctgcatcgttgcatcaaggagtacagaagggaataggaggaggaggcatatcccgaagaggtactgtttctgagtatttttcggatttgctaccgctctggagaatggatgaatttctcaatttgcctgaattggacaatggttatggctttggcgaggcaggttcttccagggcagataatgccaactttgtagaagaatggcctgcaaattcctttagcacggaggaagataattctgaaaactgtcttgcacaggtgcctgaaatggcatctccaccaacagcatctgggctttattggcctcgaaaaattatttgtcaaccaaaggaaggcaagcgaagagaggacttgacgatctttggatttgatgatgcttccttggttcctgacatcggatgccgatcttctccacctgattctcctctttctaagagaagaagattgcatgcttaacttcgtttggtcttacctcgagagtctaaatttttacccacttagataatgattctgttctttcgatctccggacctgttatagttgatgattgatcagataaatgcagcacatataagttatatgcttatttccagtgagagtgagcccctaaggtgcgggtacccaatcattggaatctgtgtttttgtgtatgcctttgagagtcctatagatgcaactgttttctaaatatcctcgagtagaattgctcgccaaatgggatgcttgtatcattcctcagcattctagattatttgtaagtcaatagttcactttcttgtcgagctttggatttaaggatgatcttgattaggatgacaggctaacttgctgaagagtttttcccatattttgagtttattattatgctgaattcttcatatgttttcatgtaaaatactgatattatcatgggctagttcaactgcctttgtacttttcattaaatgatttgcttcaagcaaggcccatttacaaaaaaaaaaaaaaaaaa

SEQ ID NO: 1862 - DNA, 2363 bp, Pinus radiata
tattagatgcttccatctgggtctgcaacttggcgcaacagtgcaggactggtgtgtgttcgcctgcatatcggtttttcaaactgtagcggttttcaaggtgttggattctaagttagctttagagctgaaatggttctcagctccatccaagtctgcatggattctgactggccacagagtgtcatgcacgagagaaccctaaagcctctggaggaaatgatgccggcttgctcccggcctatgatggaacaaagtggattgaagccaccaccgccagatcaaccactcaaatgccctcgttgtgattcggctaacaccaagttttgctactacaacaactacagcttgtcccagcctcgccatttctgcaagacatgcaagagatattggactagaggaggcactctgcgcaacgttcctgttggtggtgggtgccggaagaacaagcgtgccaagagaacaatagatcacgcttgtgctcaaatgaacgaagcttccacatctgttaatgagttaaacataaacggttcagctcccctagggcattctcaacttgcaaattctatgttctatgggcttcctgcaggaagtgctactactcatgatggcatccacaatctttctcttgccacaaggctggcagatcagagagcgctatatggcaatgattctgagtttctaaggacattctttgatccccgtagctgcaacctatcccctctcaatgggctttcctcactgaacgccctcaactcttttaagcccacttttccaggtctcaattttaattctaaccctaatagaacagaagccctaactagagcagtcagagatatagatgccagcttctttgaaagtctccccacacaaatctcagaagtaccgttaccagtgctgaattccactaattgtgatgatttgtctccgtattctctatctctgcaggaagggatcaataatggcaataccaacaggtattctgaggccaatcagtggagagcaattgagcagcagaagctagctgagggtagtgatcctgtacaggtaggtttaacccctttctctgaaatggaaaacagtaataactccaggaatgatcttaacctaaaagtggtcacaagcctcccttcttgtgtcaaggtggaaggtcaagacaatcgtttgaatataactccagaatggccagttccatcagaggccttgtttgaggcagctagtgattccgcatattggaatggaggagtatggcctgagcttactaattatggatcttctgtaggctccttgatctagaattaagataatacccattagctgctgcacatgaaatgcttcttgaaagagcatgaattgatgagagaaacgtctttttttcagatgaaggaaatgtcaagcattagggtttagacttccagggctgactaattgtcatgtagtctggccagtctctccagatgaaggcttccctacacttgaattttgttgtgtttgtttgtttgtttttcatttgtcaagaagatctataagatgggtcttcatccatgtccaaattcacttcatagaaatgcagtgacatgatggacttgggacattatcaccatgacagaagctggctgaggaatacagatcaaatgtacagcatgagaggtttgaagcttcatttttttccagcttcaaacatcgcggggcaacaaaggttggggttaataatttgccttaattatccaagcaaaattgcaaggagaggaggaaatcaaattatcacatccagttctatgcaggacagctgaatatgctaactcacttttgtcttgagtttgtgagtcaagacaaacttattgctaaggtcaggtgaaactgtttcccaagtttaacagttttcttttgataatcagttggtatcatgatgatattctttgtaaatatgcagaacatgctatatgtttctggagtcatgaagtttgagattgacaggagtgatggcacaagaaggctgaagctttcatggccatctttcgtgccagtgaatgggtatagggttttcatgtagggggttattcagaataattaagcttgttggagtgggtttttctggaaggaaaacctgcattctttatagaagcgatattttggaaataaactcctgtctattgtggagtcggcagaagagcttcttcttgaaattaatttctatggtgtgttataggatgggaggtagttaggaagtctgtagtccaaaactcgagagagttggtggtgtcctgtgttctttaaatagcgtaacatgttatcagttgtttctcaaactgtactgctaaataaatacaaaatatggtgggtgattattaataaaaaaaaaa

SEQ ID NO: 1863 - DNA, 2277 bp, Pinus radiata
cggccaggatttgaaaacgaaggtacacagatccaagcactcaaagcttcccagttcgctctaacccgaatccagtttcagggtcggtctctgtaaaattacatcacccacaaaaactatttaattgtaaatggatattcatttattaattcaataaaaaaaattcagtcggtagccgaggtcacgagttcgattcccatggattctgaccgtttgcacagtcaatgcctcccctatttgtgcacacttgcttaaacttgttgctgtatcgtatttgcggtttttgggtaccctgtgagattaggttaagaattataactaactgccatttacagagggtttgggccactttaaatatcgcaagtaaggattgacgctgcattttgatatatgcgagagtttgtggaagttaacaaagatatttttacagttctgagcagaaagcggcaggcttgggttgtttatgggaattttgaagacaagttttttttcttaaaatggttcaggccactaagtgttgcgaagagacctttattcttgttagtgattaaaatggttcaggccactagtgttgcgaagagaccttaattcttgttagtgattgacgaattattagtcagtgggatgccgggagggtgttactagggttcataacttgacctgagtttaaagggttgattatatctggtgttccggcatttgacataaattcaattagagttatgtaaaaaagatgtcggacgcggatcatctggatgctaattctcaaggtgtccacaaccaccctcaaccgcagcagcatggttactatgcgcacaggcaacagcacatacatgccacttctcaaggacatgtgagcggccaccatgttcatcttcatgatgtgcacatgcaaggtcatgttgagggaggtgtcggcggccacccggaagcccagggaggagagccgcggcatctccagttgcaatacattcatgaacatgggcattcgctccaccatagtgatgataatgggctgggagaagagcaagatgatggtgatggcgagaacgatagcatggagggcgatattccttcctctggatgtaaccttggagattcccagaagattgtacctgttcgctctcaggcaacgaatcagctcactctttcataccagggagaggtttatgtgtttgatagcgtgccacctgagaaggtacagtcagtgcttttactcttgggtggtcgtgaaatacctccaggcctctcaggcatgcctattcatggccatcatcatcaaaaggttttggcagacattccacaacgtttgaatcaaccacaaagaattgcttcacttacgagattccgggaaaagcgtaaagaccgttgttttgacaagaagatccgctacagtgtgcggaaagaagttgctcttaggatgcaacgtaacaaaggtcaatttacatctacaaagtccaattctgaggatttgggttcatctgcagcaaagtgggatccctctcaaggttggcaccctgacagtaatggtaaccaacaagaagttgtatgccttcactgtggtattggagaaagatctactccaatgatgcgtcgtgggccagctggaccgaggtctctttgcaatgcttgtgggctgatgtgggcaaacaagggggtgctgagggatctttcaaaaaacccatcgtcgttggggagccagaatcaaccttcgagctcacatgaacagaatgatggaaggggagggagccatgaggtcgaggtgggtgacagaaatcatagtgtcactgttccaacgaatgagcatatttcatcatgacatctggtgcagaaatgcttgtttaaagacaagtaattatttgtcttcatctcagcagggtggtgactgtttagtgctttatgctctcaaacctttttaaatctaaatgtgtgtggaactgctgtatgaaattatccttcagaagggttagaataatttccacaaggggaagtaattgtaggaaatgggaaatggaggaggaattgtaggggctcattattttaggtattccccaagtcgaaaatggtaaagtcatgtaagagcactagtataatttatttataactgaaaacttgtatagggccccgaagtattcatacattaacaattctcgtatagggccctggtaaattgcattagctacaatcttcaaacatattgttggccctgcttcatgcacaggacatgtaaaataatagtattcaacaaataaagcagcattccatgtaaaaaaaaaa

SEQ ID NO: 1864 - DNA, 2683 bp, Pinus radiata
gtgtagatccaccaagttccttttctgggtttttgctgttttgtttttggagttctatgtcagcctagatattcttatcccttttaattggggagggtgcgcacaagatttgtatcgctgaaaagggggccgggttcgatgtcaggtttcttcgggttttaaatcgtttgccctcttggaattctgtgttttacctggtatatattgacgataataattcatctctttgagttcttgggtttcttcgggttttgaagcagttgccctcttggaactctgtgttttacctgctccggctcaggttcgatccatggaatagcacaagtctgcgcggcacagggcttcgttttatttcctttagagataataataattggaaaacaggagaaatatgcgaactctttgtgatagctgtgaagcagcggcggcgcagtttttttgtgcagcagacgaggccgctctctgtgctaaatgtgatgaaaaggttcatggttgcaataagttggcaagtaggcatgtaaggctgcaactgagggaatcatggtctataccacgctgtgacatatgtgaaactgcagcaggtattaatgcgtttttttgtaattgcagcaggtattaatgcgttttttttgtaattgcagcaggtattaatgcgttttttttgtaattgcagcagtaattaatgcttttttttgttaaggaatgtgtttaggttataagagattaatattatttacaggtattttaaatatcatatccataatttataattagtaaggtgtttatagttatcactaatttttattcatttacagattaatatattaggaaaatattattttgtcataatttttttattaaaaacaatttttgatgtcttttttttaaaatctctatttgtgagaccattttaagcttttctttgggttataatactgtgttgtaacagccattaaaatttcacaaaaatgcttcatatgcccccataattcataattagtaaggtgtttctcattctttatcatttacgtatgaatacattacggaaataatgtttttttaaatctctatttgtgagatcgttttaagcttttttatttttcctttttgggttatggtactgtcttgtagcagccattatggtatggtgaagtctcagcttgctttgttttattttatttatttatttataattgtattagtattttatacctatattttttattaaatagttataattatagttttttatatggagtgatttaatttttattttttttgttgttaataaaatttggtgatataatttttggtaagattgcgaagtttaaaatgtatttctgaatatataaatggattcagttatctataaaatattaagtcatttaaattctataaattatattgctgaaacttattatttcaagaaatctataccataaaattgcaaaaaatccctatcaaatttagagcgaaaaagtagccaaaaaaaaccccaaaaaaaaccccaaaaaaaacaaaaatgtctgagagttagactctgcacttttatctctatctaaactctgcactcttatatctgtctaaatttccttggaaacataattggaaacaaaattctggttattgtactctgtagttttttgtttataaattcaagaattacttgttgacggtaataattggctaatcttgcaactttagtttttttgtttataaaatcaagaaatacttcttgacagtaataattggctaatcttgtagcttttgtactgtagcatttgtggctaataaaatggttttatttctgaattacatatattgtcctttcttttcataagtagttagggtttcagtttcttttatacctttataaatgtccttggagacataattctgtttattgtagtctctgtactctgtttataaaaccaagaaatgcttatttaccgtactgatgggctaatcttgcagcttttctagagtgtagcattggtaactcattattgtgctaaaaacggttttattttttaattacgtacatggccctcttctatatctcttcaagaaataattctgtttgttgtcgacagttttttcttccctttaatcaacagaaatttcttgggaattctgtgtaaaacgttgatatcgcagctatttactgtgaagaatctgctaatcggctactattgcagcttttctacactgtagcattgatggctcatcactatgccttcagtgtgatatggatgtccatgtaggtggcaagagaacccacgtaagatatctattgctggggcaaagagttgagcttacaaatggaagtcacatacgagatgaacacgggaatcctaaaactatggaaacggcaagagcttggcagaaaaagtattgtcaagagcactaccgcaatggggatccttctcataacaacatatcgaatggtaacatccataatgttgcatcctgtaataaagaaaatgttcaatccaatgggcaaaaggactgaaatatcatttagttcctcctctgataaaaacttgtcagaaggatgtgttaatgatagtgttgcaatcatgttcagggcattcactgggcacttgttctcaatatttgctctcatttgtatcttaccctccaagcaatttttgaatgcatttacgaattgtgaaaaaaaaaa

SEQ ID NO: 1865 - DNA, 2460 bp, Pinus radiata
gtcggttccgttgtgatcgtgtgtaatgagattcgaaccccggaacttgtgttggagaatgtaatatatttttttctgattatattttaaatttagaaattaaatttgcagtggagtgtaaattctgagatgaaggatccggggtttaagctgttcggaaagacaatcccgatgcgcgacggagaaaaaaatgacgggttatcgggttcgaaactgggccacgagaataccgataatactactggaactcctgctcgagttgctcaagtttccgacaaggatgtaggcaaagagataggccctgagcttggacgtgaaggtccacataatagtaatccagaagagacccgaagcgttacagtcatcagtgattgcggagaagatgaatgcaagaaatctgacgaagacctggagagagaaggtggaagtacagcaatagaaagtgacttgaaaagtgaaaatcttgaagaaaaagaagcgaaggcaagtgaaaatgaagataagatgctgaaaaaaccagacaaattgttaccttgtcctcgctgtgacagtttagataccaaattctgctattacaataattacaatgtgaaccagcctaggcatttctgtaaaaattgccagagatattggactgctggaggaacaatgagaaatgttcctgtaggtgcaggacggcggaagaacaagcactcaacttcacattataggcatatgatgatggctgaaggccttgcaacagctagagctgatgctcccgatggtgctgctcaccaccaggtcatacccaatgcacattcttcttcgtcaagggtattgaagggttctcaaatccagcttcttcccttggaggtagaatctgcagggggttccattctaaattttggacaggattttcgtctttgtgaatcgatgtctacaggtcttaatttggcagatcagacagtggtaactagaaaagcctttaaaatcaaggatgatgaaaagggtccattgatgtgtggagaaaatagagatgacacttcatgtgaatcttccactaccactgaaaaggatgtggcatctaaaaatttccataccattcctcaaatggaccaaggaagcatggtgggatggcctagtagtgttcctcctcagcagcactattatggaggagctccctgggcatatggttggaacttttgttggggtggtcgttctgcaacaggttgccctagtggtatcgcctatgctgctgaaagtggtaatactagtgccgggccctggaataacggcacatcaggggcagggccgcctggtatgtgggcagcaggaattccttggccttttgttcctggaccatactgggcaagtcccacaggctggggagcagggacttggaatatgccattctcaacagtggcatcacctgtgactgggggtttgtcaagttgccctccctcgagcagtgctggtagctctggatctccaaccttaggaaaacattcaagggacattccacagtctgaggataaacctgatggatgtctgtgggttcctaaaacagtaagaattgatgaccccgatgaagctgcaagaagttcaatatggacaacattgggtattggaaataaacctgaatcaattacaacgggtggcatttttaaagcattccagcccaagacagaagagaaggattcagtgaaagcttctacacaggggttgcgctcaaatcctgcagcattttcaagatctatggcttttcaagaaagcacttagaacttttctcttttcaccttcatttctttcagggaaggcttttagccattttacgaatgctctcataacacccaagaagatgttattgggaaatttcagtgtacattgtaaagtattttgtttcttactttggttagcagtccatattttctggttggcaagtctagtcagattttggagttgtatcaaagagtgtaaaagtttgtgtcgtttgccttcttatccaagcattttttacaaatttgcttgtgctgtgaagaagtggcattgatggtcacgagctataaattgctagaaaacatgataaatgagggtataataaagcggcaagagcttggatgactcaagaagcaagaaactatcttacagtcaaaagtggttattggcgttatcacaagagaaagagagttgcctgacatatttggagggatgttcatcaagagcagttttatatcctagccctttttcttcgttgcattcttgaattagtcaggagcatctttatttagtggagcaagacagagccacggttgaatattagaacattgtataatctttcattgccagagatgagagtgtagatgctagtgtcttcaggtaggctttacgttacgttgacattacagccaaagaatcagtctggctagtttatgtgatcacgagccatgaagctgatctgtttcttttgtctcatgaaaatgg

SEQ ID NO: 1866 - DNA, 1124 bp, Pinus radiata
gagagaaagaaagattagccaatgtcctcctgtctaaccatggaaaaacattcattaaaggaatgtgagctctgcaacaaattgcaagccaaaatggtttgtgagtcggacaaggccaatctctgttgggtttgtgatgtgaaggtccactctgcaaattttattgtggctcgccatgttcggaagcttctttgccatttctgccaatccccaaccgaatggcaagcctcaggagtgcgtccatccccaactctttctctctgtaacaagtgcttctccgccaaacactcagctagaaagcatcagtttgatgagaatgatcaccatgtggttactttcacaccctcttctgcttcatcacgctgtggagaaaacgatgatgatgctcgtggacaacatcagcggtatgggaatggcaactcagctagaaagcatcagcaggatgggaatgataaccaagtgtttcctttcacaccctctttggaagcagctgcctctgcttcatcaggcactggagaaacactagtcatgccgatgcacaacacaggggactttgaaagggcagctacaagtgagaattgcagtgaatggcattgacccttgtttgaatcggacaaaaggaaatcagctggttagttgcaggcaatagtaagtaatgtttttttatgtgatgtggctcagattgcaagggataagacttcagattgtgatgatcgataattcagtgtggatctttgaagccatcatgaccaagtatgtacatataagcttggagttgcattggattacaacagggtttttttctttttccgaagaattcagagagggatcactagtgaattcatttttccaaaaaattcagagaaggattcatttttccgaaaaatttagagaaggatcactagtgaggagttgaaatggtctgttggatccatgggaatagtttcttgctaatatgtttttttgttacgcagatctggtcaacacatcaaagaagttttagtatatttcgaaatataatacatattttgaaccatatttcactctattgataacggatgtaagctgatataagcactctttgattagtagaaaagtgttgttttttctcagtaaaaaaaaaa

SEQ ID NO: 1867 - DNA, 1789 bp, Pinus radiata
atttgcggagatttttattttttttggcgaaggattcagaggattcttggcggaggatttagaggatatttttggggtgtaattgtgaatgaatgaaggcgaagaagggcatggtggcaaaggccatcggtggccgcaccgctcgaccctgcgacgtctgcctgcgggagcgagcccgctggtactgcgccgccgacgaggcatacctgtgcgaaaaatgcgacggggctgtccacagtgcaaatgccgtggcaagaaggcacgagcgggttcgatttgcggcgggctgcgccaaggtggaggctggatttaatgacggcctgatatttcccggtacccggaaacgcgcccgcagtagccgcccccatccccatggcgccgggccgaggtcgtttaaatcaaaggtggggagcgtgaaggacgagctagtggccgatcccgctgcggtccccgtgccggcggattcctccgccggcgatatcaatctgaatctccgcgcggacgatgatgattatgacgaggacgacgatgacttgctgccgcaggtgccgacatttgtgcccatggccgaagagctttgtgggtctcgaccgcgcgacgtcgtggagtgcccggtgtttgagcagtataaatatggtgtcgagctgaagggcgattgcggcggagccgacctggggagctgcgatttagatcagttattgaattctgagacggatctgtcaggctttggcgtcgatatggacatggacgtggaaagcataattgggcacgggttggacgagggtcttggcgtgctgggattttccactgttaattgggacgagaagcgggttctacagtgcagagatgtgaagataaatgaggggcaggatcccgagcagcagaaagacggcgacagtggcccaactgggttgttgaacaacaggactatcaaggctgaagaggacaaggatcgatccgacgacctttgctcaaaacctaaagacgagggcgatcatcatgtggccctgaaggctaaacaagaaccagatgaaccggatcagtcgtgggacaccatcgagttagacctggatcagtaccatgaagacgaggaggaggaattagaagatggcacgggtttcggggatcagtactgcatggcacaaggtgcatcggatgaccaggggcatgactatcaggacatcaagatagagtttgacccgagttcgattctgatcgcagggcaggcgatgtacagcgagacgaagttggtgtcgctgagtctgaattacgaggacgtgctcacggcgtggtcagaccgaggctcaccgtgggcttctctccacgactgtaactcggaaggagggggatgtcaagacgctgggcttgttccagagctgggcctgagctataatggtgcccaacttaacataatcggaggaggaggagggcaagaagattcttgcaggaatgctggaggaggaagagaggctcgagtgttgaggtatcgagagaagcgtcgcaccagacttttctccaagaaaatcagatacgaagttcgtaagctcaacgccgagaagcgaccgcgaatgaagggtcgattcgtgaaaagaacgccagggatgttttgtgactgatgacgacgataaataataatagcagcagcaactagcacaagttagtactgcgttttcggcttctgcaagctggaaggaggaagacacattatgtaatatatggagcaggaccagcaattatgtattatattaaccagcaattttaattaatttcagaatgtagagttagacac

SEQ ID NO: 1868 - DNA, 833 bp, Pinus radiata
gtgaaatgggtaagagaatatagtttagccaatacctggctaacacagcaagacggtttgaaaattactttcacctgctggagaacatttattatgaggaaccaatgaaggaatgtgagctctgcaacaaattgtcagccagaatgctttgtgagtcggaccaggccaatctctgttgggcctgtgatgccaaggtccactctgcaaatattctggtggcccggcatgttcggaagcttctctgccgcgtctgccaaaccccaactgaatggcaagcctcaggagtgagtccatccccaacactttctctctgtaacaaatgcttctccgccaaacagtcagctagaaagcatcagcgggatgggaatgataaccaagtggttcctttgagaccctcttcgcaagcagctccctctgcttcatcaggcactggaggaaacgctggtgatgccgatgcacaacataggggagcttgaaagggcagctacaagtgagaattgcagtgaacagcattgaccgttgtttgaattggacaaaaggaaatcagttggttagttgcaggcaatagtaagtaatgtttcttttatgtgatttggctcagattgcaagtggttagagctctgttgaaaaatgtggttagagttgagaatgtgatgactagaaattcagtatggacctttgaagccatctttgtacttataaaagcatggaatctgtcacattcagatttagaaagctcattgataattatgagaacccacaatgtaagttacatattctctgatctcacaatgtaaatgcagcatctaagcgttttcaatataaaaaaaaaa

SEQ ID NO: 1869 - DNA, 1792 bp, Pinus radiata
taatttgcctgccctttcatgcacaatattcactgtatatctcatccctccctgcaaggaaaggaagatgggaaagggactctagagttgttaggtagtgatgaatgatcaatgataaatggtaatctctctggttttaacttttgatttgaattaaattgaatggaatcctggtttgatcaatcatgtcatgaaagttttgccaattaggacacccttttgatgtcatgtggatcatgttgcaaatatttcctaggtttagaaagactacttcttgatgggtggtgcagcagcagcagcagaagatgatgatagattgcctgtggagtcaccaactttagagttagcaaaaaaggaggaattggtatgtagtggttcatcatccaaggagtccttgaaacgccagagagaggcagatttggaagttgaggcaaactgcaagcaatattgcaatgggaaagtgattgtggacgaggaaaatgcaggagcaggaagaaaatctgacaatcgggtagagttagggtcactgcctttctatatgttaccacccacgaagcctagtggaaggcctggggtatacaggatcttgcatcagcaagatcatgaagatggggagaatcaatccagcggaaatgagagttccatgggtgaggaagtggcacagcaaagtttgcccagagacctagaatcagggtttgatcagggaagcgggggggatgaaaatggcctcagtgggtctaggggaaaagctttgaaattatttgggtttgagtttagagggtcagaaggtggatcatttgaagggactaatggttctgatcagccacaagatgggactaatatattaactgcaggtgaagcatccactgagccagtggaggaagaactagtgattgaggccaaaaatggagattcagggaaattagaagatgtgggtagtccagtagaggctggagaaagtggtagcactagcaattgcctgggatcatctgctcaagaaaatcggaaatatgaatgccaatactgttgcagagagtttgcaaattcgcaggctctcgggggccatcaaaatgcgcacaaaaaagagagacagcaggccaaacgcgcgcacctgctggccaccaggagcgctgctgcgagtgccaacagaagtggcgccactgcatggtgcgggaacataaacggtaacctctaccatagaaatttccttttcaataattcctacttcacacgcatgcaggtgtttcaagaagatttcccgacctttcagaccccacaggctgttgcagctccatcaatcccgcattatatcttcagttaccagcagcagcagcaggcgcccgtgcagagctcgctgcctggattaatggtcagttcccaatgcgggcagttcggattaaacgaagtcagacaagtccctatttatggggacaatgtcaataactattccttcaaccccgccactgccctaccccaacctccagtgcccattccaacttctctccattcaagtggcctgtcaaggatcagacaagccagttggtcgattccgcctccttgcagatcgggcgagtggcaatcagaccatgcagctcctgttgtcatgcccgtggaacgcaaatcttcttctgacaagtttggactggaattggatcttcaattaagaataggtcctaatgcgaatcccaacagtcactttgagtaagattttatgcttctttgggttatttttcctgtaagcttttcagacttttttcaatgaatgcagagagattaaaacctaaaacctaaa

SEQ ID NO: 1870 - DNA, 1964 bp, Pinus radiata
ctctgctggatccatattctgtaggcattgacatgaatataggaacagtattgatcaagtttccttagagaataagactatggaaagttatgaatgatgcataccttaataggtggggttcagctctattctttggacaaatggcagagatatcgccagaaccaggcacgccttgcagctctgctaactcggccaggcttctccatggatcctcgtcaccttcacaatccatttcccagcaatctcattacaaatcgcctttacctcctgttttacgtggaacaaacaacaagagagcgcgtcgtccagctggaacgcccgatcctgaagcagaagtggtttcattgtcacctaagacattgatggaatcagacaaatatgtgtgcgagatatgcgagcagggattccagagagaccaaaatcttcagatgcacagacgcaggcataaggtgccgtggaaattattgaagcgagagacaacggatgcacgcattaaacgagtgtttgtttgccctgaaccaacatgcctccaccataatccttctcatgcgctgggagacctggtcggaatcaaaaaacattttcggaggaaacacagcagcaacaaacagtggacatgtgaaaaatgctccaaagcgtatgcggtacaatcggattataaggcgcatatcaaaacgtgcggcaccagaggtcacacttgcgattgcggtcgcgtgttctcaagagttgaaagcttcattgagcaccaagacgattgcactacaactaaagacaagatggttgatgatgattatcagttatccatgccctgctcattcaccggaataaatagtggcaatacagtcattaatgccactgagagtactgctcttttcactgcaaccatgtggagaggcatcgagaatgaaaggctggatcctaactggtcttcaatggagcaaagacaagagcttcaacttatgccttccaagcaacaaggcacatctgaaacttctgaatttcctcaaccatattcaaagccagcagatgaaaaaagttctcctcggttgcagctatccattggactgggcagtgagatcacagaaaagaaactcgaggagaatgagatcaggattaatgaggaaattgaacaacaaaagcagctggcgatgagactggcatgcgatgaaatggcttacgcagatcatgtacgaagggtggccaaaaggcagctggaattagcagatatagaacttgaacgagcaaagaaaataagagaggaggctcatgcagagcttgataaagctcgattcctgaaagaaaaagcaaccagagaaatttctgaggctgcaataactcctctggagataacatgcagatcttgccagcgccagtttcagtggccgctgcaatatcaatctccttcactaaatggcttcttgtcgtctattaattctaataaaggtggcgcagatgatgaaaattgtcatggaaacgtgtttccagaagttagcatgatgaggtacatgcagttctccaatccagctgtcatagaaattgacaagggcagtcaagataaaatgcagatgtcattatcaaaacctaatggccagctgtatggtgctcatgttagcagaacactgtcaagctccgttacttcttccacaaagattgaaccctgcaattaaccaaaggtttttttcatggtagatgaatcatgaagccatgtgaaggcgggagaatctacctatgaattctgaatgaggaatattttttcctggttatggccgcctgtgcactgaactctgggaaattagcattataaatttgatgtctcgcctattctgggtgtttattagtactgaagttatcattcattctttcaacgctgggattgattcttcaaatattggacactgttgcaagtccacttaatattatatggtgtatcgcatcatttcatttcatttggaacttggagtcaa

SEQ ID NO: 1871 - DNA, 2193 bp, Pinus radiata
aaaaaaaacacaaatatacacacatttgtagttgatgatgatattgatgtttgtccagtttgattattgaataagtgacaaaggaattagcagctagcagatccaagagacctggtttcacgatgtccagttctccaaagctctcttctgttgtcagtaaagaccaagatcatcagcataacatgttgcacccccaccaagaacaacagcaaacaacagcagctgcagcaacaaacactgggcagaacaatactactgtgaagagaaagagaaatcttccaggaacaccagacccagatgccgaaatcatcgccctatcccccaagactctcatggccacaaacagatttgtgtgcgaagtctgcaacaaaggttttcagagagaacaaaacctgcaactgcacaggagggggcataatctcccgtggaagctcaggcagagaaccactaaagaaattaggaggagggtttatttgtgtccagaacccacctgtgtccaccacgatccatccagggctcttggggacctcaccggtataaagaaacatttctgcagaaagcatggagaaaagaaatggaagtgtgaaaagtgtgccaagagatatgctgttcagtccgattggaaagctcactccaagacttgtggtaccagagaatatagatgcgattgtgggactcttttctccaggagggacagcttcatcacacaccgagcattctgcgatgccttggctgaggaaagtgcaaggattcctactggactagtaggaggccatttatataacaacagtgtcttaagtttacagggacaaacagctggctctccaatgtctataatgacagctccttcatcctcggccttcaggccttctcaaagctttaaccatggaggagggggacttaactcttccatgttttttacacagtccccaaaagccattcagggttttctgcaagactatgatggtaataattcacagggaatgggacacgagaagccaaatttatcaggcctaatgcacctgcctgctggagcttcgaacaataatcctgtaaacctaacctacccaaacctttttacttcaactgcctctcatgcagatctccaaccgaatgcaggggcaatggattttactggcaacggtgcccagtcaatattcacaaataataacggcaacgatcataatgctgtgggtactcaggatcaaaaccatggaggcatcagcctgcccaatctatacagccagcaacacgttggccaaagctcaagcagtacttctcagcctcaaatgtcagccactgcattgcttcagaaagctgcacaaatgggttcaactgcaagcaactcttcaatgctcagaggattcaacataagcaatgcaataccaccctcaggctccagcaatcacaacaataacaacaataatatcaccatgcccttcagtggcaacaataacctaaggtcattagagaatgagggcctcgttcatgacatgatattaaattctctagcagctcaaggatcaggaaccatgcagtttggattaaacaacatgaaccaacctacatatgcaggtggaaattacagtgttgcagatcatagtgagcatctcagctctgaaactgagaggaacacacaaacatatggcaatcatggatcaggaccagtccaaacaaaaatgcaaggaagcaatcaaatgctaatgctatcaggcatggggaatcacaatgttccacgtaatgaagatggaggaattgcaggtgatggattgacaagggacttcttgggtgtgggaggggcttccagtgcaggttttcctttcaggagtcatcgtgctgcagcagcaccaccacatgataatatgacatcaagagactcagaaaccaattcaggatcttacaataataatagtaataataataaaaataataataataaccaccaccaccatcaacaatgggagagtttgaggtaagtcttgaatatctgtagcaattgtattcatggatggtggtgagcctgaaatgcttcctcaacattccaacaattttctcaacgcttctgtgtatgtgtttttctcagctaatgcttagctttttcatcgtcattttccctcgaggttcttgatcagtcggtaccgaacacgagagaattttatttcaagcattcagtctttttatataaaaaaaaaa

SEQ ID NO: 1872 - DNA, 1334 bp, Pinus radiata
gttgctgttccattgcatggtctcccattcaactgtgaatgggccatggatccccttgtctctcacctgcctgcagagtttcctttcccatatgataacagcactacgcccacctaccccgcccaggcagactcatcctctgttttcatgcattcccttctctcaattcgtcaccttccttacgctcatcccatttcaacccacaacataaaacccactcctcctcagaacgaggctgatgattatgaagaagaagaggagcccatcctcagtctgcggccgcctggccagacagaccaggccctcaagaaatccaacactcagccctcttacgccaccgatccggacgaatccgacgacaatgtgaccgtggctctgcatatcggcccaccaactcctgtttccctggactgcgacacggtttcaagcgttaacgatgggtgtttccaggcgaaagaaaggctgcccatgggtcaatattggatccccacaccatctcagattctcgtcggtcctacacagttttcctgcgctgtctgtaataagaccttcaatcgttataacaatatgcagatgcacatgtggggacatggatcccagtacagaaaaggtccggactcgttgcgaggaactaagccttcggccatcatgcgactgccatgttactgctgtgcaccgggttgcagaaatagcatagaccacccgcgttcgaaacccctcaaggacttccgaacgctacagacccactacaagcgaaagcacggcatcaagcccttcgcgtgccgcaaatgcagtaaggcgtttgccgtgcgcggagactggcgcacccacgagaagaactgcggcaagctctggttctgcatgtgtggttccgatttcaagcacaaacgctccctcaaagaccatatccgcgccttcggacagggtcacgcgccgcacggggtcgagtcctgtgaagacgacgacgacccggcaccttcagaagagctggacgatggttattctgggacttctcaatagcaaatgtatgaattattttacagaagaacaagcctggcgtaggctagattttgttgcttccggctggtgtaactttttctttttcagaaattgggccgggagtaactttcaagcatacataatctccaaaaacctgtaaaatatatattagatagtgtatttaatcacggctagcgcaatgttttgtattcagtcaatacgggcactgtccaaatgttgataggccactgcctgtctgcaaatataacagaaaagcatggattgatacaaacttactacgttgtaacacgcacattcaccttcacattctgtaa

SEQ ID NO: 1873 - DNA, 2614 bp, Pinus radiata
ggtcacagtcttcccttggtattattagttcggccttttgaagttctgcaggctgacttgcccgcagaatatatatatatagagagagagagattcaaagtaaaagctgagaccgcagagtttctcgatcaaatgtctaacttaacgtcggcgtctggtgaagccagcgtctcgtctggcacaagaggggatgtaaaaccggtgcaacaattaactgtcaacgctgctgcaaatacctcatcacagcaaactacaatcaagagaaaaagaagccttccaggcactccagaccctgatgcagaggtgatagctttatcgcctaggacattgatgactacaaacagatttgtttgtgaaatctgcaacaaaggatttcaaagagatcagaaccttcagctgcacaggcgagggcataatcttccatggaaattgaagcagagaaacagcaaagagatccggaagagagtttatatatgtcccgagaagagctgcgtacaccatgacccagcgagggctctaggggacctcacaggcgtgaagaagcatttctgtagaaagcacggagaaaagaaatggaaatgtgataaatgctccaaacgatatgctgttcagtctgattggaaggcgcactccaagacttgtggaacccgcgagtatagatgcgactgtggaacgctcttctccaggagggacagctttatcacgcaccgagcattctgcgatgccttggctgaagagagtgcaagagtttcggcaggaataactgtgggtggcgtccagctgccgggcaacaattccctaagcgcgggagcgcttcaagcaggcgcaagttcaatgccggtaatgagaggagtcatcggaggtggagtcggatcggcttcttctttcagaccaggcggcagtggaattcctccattgggcgccgcgcaatttccattcagtatgagatcttctcgtatggggggacttcccgagagcggattatctctcgtcagcaacacaaacgccgggccttccagccggcctcggctctcactgtggcctgaaaatagcgatcagatgatgggcggggcgcagcagcacaattcccaccagcagcacattcagccaatgaattccatggacgtcaatccgtctgcatttttcgcgcagtcgccaaaacccatccaagccatgctcgggctgtcagaatatgatgactcgcaggccggcaaaggcgccaatttagcaggatttttgccaatgtcctcgtcaaattccgggacactttattcaaatcttttgacttccggttccctcaatgtgtccaatgggattaacacggatttcggggtgacaaactggacggatcgatccggatccgccgcttcacgccgttctttatcaacttctgcgggcttgacgacgagttcgtcctctaatactaataataacatcaacgtcgacagcttatacagtagcaataatagcaccaatgcccaaccccagcagcaccagcagcagacctatatttctcaaatgtcagccactgcattgcttcagaaggccgcacagatgggtgcaactgccagtaactcgccaatatttggagtcttcggcatggcgggttcagatatgggattgggcttatcctggcacgattcagcacctggcggccaagaaaaccagcagagagcagctggaatgggagaaatggtatctggactggatcataattctcaccccttcagcatcagtacttcacatggaggtcacactggatcccattttgttggaaacactagatcaccagaacatgcagggctgcaggatttgatgaactctctctcaggagcccccggcagtgggtattttactggaggcgttctgaacaacgcacagtatgggggcaacgttggggattccagcaacaattttggcagaatgataaatatttcagcaaatgcatctgataacaataatcaacgcatgaattctctcagcaatgacattggttcgttttctcaaaagtccatggggattcaacctggaagaaatcatcaaaatctagtgttaccagccatggggggcctgaacccacgtactgtggagcaagaaggtggagacggattaacaagggattttctcggcgttggccatgctgcaggaggtctgggaagaacccatctttcgcagagagaatttgcaaacatttcatcacttggctctggaatcgacttagtaccctataccaaccaaagggacaattcacagtcagtgggaactgcagatgccgggctctctccaaacaaatcatgggatgcttcatgaagccaagcaagcaaatggttaccagttggcggaagacagacctgcagagcaagcactggttattgttgcaatcgcgctcagcaagcaaggttttcttaactctttgcacaagttcaaataaatcaaatattcatggtaagttaagttcagttctgtatatttattgaccaatgtttttttcgaccattggaagtttgattcacaagttgtgatccataaaccataaacgttacatttattagcaaaatcagcgctcaatatacagcacagagtccgaaaattctctttgcatgcaaaaaaaaaa

SEQ ID NO: 1874 - DNA, 2149 bp, Pinus radiata
ttgaagagccataatcgaagcttaggatttaaattactgcacttaaatggcgaaggatttaaattactgcatttaaatggcgatgaaatgtaagaaggtgtgatttccgtatgagaacctcaccggggctggagagccgtcacccatcaccggggttgaagagccatagtcgaagcttagggttaccgcatgtgatttaaatcgatcgtgatgcgtgcgtccagcgcatccccatgtcagcggagaagtttctgcctcatttcatgttctccaagcttcctttttaattacgaattcgggagcgccatagcttgaagagctcagatctgatctcaagaggcggtgtttgatgaaagaagaaaagacatgcccgtcgactctgccagactattggaaattgcaggaatggactccacgagagctggtctccagggtttcaagacggtcgatccacggttcgatcctgaaggccgccaggaagaggggttttttgtagaggattcgaatcccattggctctggtgaataccatgtcggcgaagggtttagcgggcaaatgcaagctttttccgatcttcagcgagaagaggtagctggcaatggtggcggtcagtattttgattggccactgccggcctcgaccttggaggggctgctacagggaagtagtaataatttgagcgcgtggccggccatggcggccattctaaccagcgcggcgcaggcagaaacaagcactaacgttctgttggcaaatctttcagttcttcagcagaaagctcagcagctagaggcattagttcaagaaggccggcatgatcagccggcttcagaggttatctcgtccattttgtctgaacttatcgtgaccgcggcgtctgtgttattctcggtccagaatcgagaaatcgcgaagccggcatcggtggatgttcaaccagtcccagacaccgctgcctgcgttgagattcaagccgagaatcgaacgcctccggtaggggtagggtttgggaaatccccaaaccctaatggggcgagcgatgtagggtttgaaggcgggatcgatttacaggaggagaaatttgtcgtcgacatcaaaacaggggttgaagaagaaacaaattcgccggacgataggcgttacgagatcatagagataaatgaggatgatattctggcagagcacacgcatttctgtgagatctgtggcaagggtttcaggcgcgatgccaatgttcgaatgcacatgcgagcccatggggacgaatacaagacgaaccaggcactaatgtcaaggccgccagaacagggcatcaagctgcccgcggattcttcttctgccccgaaggcgaggaggtattcgtgccccttcgagagatgcaggcggaaccagaaccacctcaatttcatgccgctgaaatcgataacttctctgaggaaccattacaagcgtagccacttgcccgaagatgtatacctgccacaaatgcaacaagcagttctcggtcgtgggagacctcaaaacccatggcaagcactgcgggcacaacccgtggcggtgctcctgcggcaccacgttcaccagggaaggataagctcttcggccacgttgccctattccaaggccacaagccgctccttcctgaccaggaattggctcgccctcctgcacccaaaagactcaaggccaccagcaacggcggggcaactacggcacagtctgccggagacgacgatgatggaagtatcgctgaatttctcactggagatttatcaggtctggctgacaacaaatttcagggctacggcactggggacgatgatctgttctttgcaccgaaagtgagtcagatgggccatcggcaaaacgaagtgccaattgagagtcggttctcggaatctgacttttgggccgatttctcaggggagttttcagatgcttgtaaataatcttattgcaaatttttctctgtttttaattgttcctttgttgaatctgctgagttagtgggattttttcgaggctttggaatagatttcatggagaacagcttcttagaatgccacatcaagattatcactggaaattgacctgttaagttttcataacaaaatatttacatttaatcaggcaaaaaaaaaaaaaaaaa

SEQ ID NO: 1875 - DNA, 1753 bp, Pinus radiata
gtccgcttaatatgtatgcatattgctattgcaattacattgtcagattaacagcgcgcgagtgagatattgtcagggttttagaggcgaaggcgagatggagcgaagaggacaagaggtgatgagttcgaatctcggaattccattcgagaacagcagggcaatggaggcactggagcagcagcatccctatcccaatccgcaggaacacgaggagcaggccggccaaaacaagccgaagtccacgaaatctgcgggtgtgaaatggatcaaagaatgggtgcctcaagagactgttctcaataatgggaagtgttattttttgaaatgggtaacagaggataccttgaaaaccctgaaagagaaacaggaagagaaggaactggagcctgaaacacttcctccaagggtttttctttgcagctatgaaggttgtgggaagacttttacagatgctggagctctaaggaagcattcacatgtgcatggggagaagcaacacgtttgtcattatgaaggatgtggcaggaaatttttagatagctccaagctgaagaggcattttctcatccatacgggagaaaagcattttacatgtccacatgaaggttgtggtaaggcattttctttggattttaacttgcgtgcacatatgcgaacacattcacaggagaactatcatatttgtccattcgaagaatgtggaaaaagatatgcacatgaatacaagttaaaagctcacataaagtctacacatgagaagaatttggcaaatgcggtgaagctgccccctcagactgaaagggagttttctcatccaaaagctccaacttcactgtatggctctgtcccttcggatcgtccatttgcctgtccttacgagggttgtgacaagtgctacatacacgagtataagttaaatcttcatctcagaagagaacacgcaggttatgctatcgaagaaaatggaagacatggaagtgatagcgaagatgaaatggatcagggaagcgaccaagatggaaatggtaggaatactggcatcatgacaggttccgggcgagggagacttcgggttaattcaaagacatcttctgcaacaaatcttcatagaaagtttttgaatgcagcagctgttgatttaaatacgaaaaccagttccagagcagtagtggaatcaaaagagcctgggaagggacatcctcgagaagatagtgaagagacagaagaagaagaacaggaagatacagataatgaaggttggggccatgggacagaaacagatgatgatgatgaagatgacaatgacgacgatgatgatgctgatgaagaagaaacagaggatgacatggactaggtaattaatataggtgtagataattgttacaggcaagaatcaagtcgtgtaaaacaaattttcttttgcaagtgaatacgcattttgaaatgtcatacaggaaagatgtgagaaataagttatctcagaggaataggtcataattaatgtgtcgaattttgttgatgaggtggctcatcaaataggacggctatgaagagaagatcatttatgcattttatcaggtgtgcatggatttgactgttaaaagtcgatcggattttcttatccggcatactgcccttttatcctggaagctgacttattgctatgcactattctattctattatattggttctaatatgaatgaagtggttgcatctcattctgaaagtggcatatagtaaaaaaaaaa

SEQ ID NO: 1876 - DNA, 3559 bp, Pinus radiata
tttctgcctaataatgggtacgttgaattataatctccaattaaccgtaacagtacttatgagtaacaatattttgggtttcagaatgacagattgtttaaatgtttgattgacctacaagaccattatcagtatgttggataaaaatccaacatgtctgacttttgggattgcctgtccattagatgaattctcggtatagtaccatagatcttctgtactcctccttccatgggttccctggaacatgaactgccttagtatcattgtatatcgttctcagtgtttgtttttttcatgatttggggtttgaattatcagatccgaaggcggcaaggttttcgtttctatgaagcgtagggttttcttgctgggaaaatgtgtttcgggctcttacagttgagtctgatagaattctaaagattttcattagttttggccctggaggggaagcccgttttactgtttagtccgaatctattttttctgttaagaagagggcgtgttttgtctggtgtttagaggaacatgatggcaggtcaggttatggagccaccatcgacttctaccaaatctgagggagagaatgacgaatccaaattttcgcttcttgggcagcaatttaggcgttatggttctactgcccaaaaccagggtcaatcttcgcagccgtcgtcaatgagcttctcgcaccccccgatggcacataaccaggttccgttgaattcccatggtcaacaatcattggtcaattccagccatggcggaagcgatggaataaatggtggctcaatctctgatgttcggcatcaacatatgcctcctttgcagggatataatttggcatatggtgcacatcgcacaaatcagaatattggggaaagtagtggttcaagtgggaatacctctcaagcttgtaaccctcaagttttactgaacactctgtcagtacttcagcggaagatccagcagttgcaatctttggtgcaactgatggcccaggaagacaggcaatcaggtcagtcatctgcgatgatggctcaacaacaaatagtgacaacgagtgtggcctcgattatatctcagttaatggtggctgctgctggtatgctccctttgtctcaggaaccaggtttgaatctatcttctatgacaactgctggagatctccagctaggtcatcttttgcgggatggtcttggtttgggattgaatgcttttcagaaaaatgatgccgggaactcagcaatgggcccagtgaatggtcctggagatgcaaacaatatcttcagtcttgaaggtggttcaggggggtcaagtacgggggcgactcttgcaacatcacatactgtacaacctcagaatcctcttggaacgtccaactctacacatggaattgggacatctattaatgtcggttctagtgatggtaaggcgcttaggggagtttcagaggcgaacgattgtgataatggaagtgatatagcaaatcaggctggagattcattgtttacatcacaacgttcaggaggacctgggtcaggagatgacaatgattttagtgggaatggaagggacgaagatgatgatggagagggagaaagcctttctcctggatgttatgatatcgtggagatggatgcagttgagattctagcagaacacacacacttctgtgaaatctgtgggaagggattcaagcgggatgctaacttgcggatgcatatgcgaggccatggtgatgaatacaagactccagcagctctggctaggcctgacaaagctcaagattcagctcctgccaagccaaggaggtattcttgcccatttgtaggatgcaagcggaataagaagcacaagaaatttcaacccctaaaaacaatgctttgtgtcaaaaatcattatagaagaagtcattgtcctaagatgtacacctgtaacagatgcaagaataagaaattttctgttgtagcagatctaaaaacccatgaaaaacactgtggtcgagataaatggcagtgttcctgtggcacgacattctccagaaaggacaagctctttggacatattgccctatttcaaggccacaggcctgtctcttctcccaatgacatggaaggggctgctccgcaagatcaattagtaaatgatggaggagcacccaaaattggtaattcagtatcaggctttgcaaattcctgtggtaatgtctcagggattctggcgggtacagaagttgttggatccattcacagtaacagtaacgccccttcaattggcccaggagcaaatggcacagtattggaatcaagtaatgatgccgttcatagtcagataggtcttaaaaatattggcttctcagaggatggcaattcacatagtgtgggagtggattcttcaaaccaaatgtctgggtttcctcaagcatttacgttccaaagcctgctttccaacaatttccttcagcaaggtagaggaaattagaaatccaatctgctgcaaatttcaattaatactgtagcaatttttggagtagagtgggtcatgactaccataactcttctgaagttgtgcagttgttggtaaagatggagcatagatcggagggattgggttcaatgctcagaacgtccaggaaagttaattaataggacagagcaaaaagacaatctggttttctttagtgcgtggaaaggggaaattcaaaaagaagacagaattctgtaacaaatgaagctttcaactggcttttctttcctctcctatttttcacattttggcctgcaggtaagagacactagtctcaaatcaatgtgcccgaacatttctcagctttgttgggtaaataaaagcgtagatcagagggattgggttctatgctcactatgtccaagaaagttaattgtaggagagagcaaatagacttgcatcttgttttcttgagtgctaaaagggaagtggaaaaaaaagaagacagaattctataactataaatgaagcttcggccaactttgttttcctttgtgtttttcacattttggtctgcaggtaagagatactaagttgaaaatcaagacgaaatatttttgtgccagaatatttctcagctttgttgagcattctgggaatagccagtggatacagccttatataggaacatgacagatagtggtcaaaatgtttctgattaaatgatattttttgtaatttattacagagataactggctgcaatgttggtgctcaggagtcagaaccctgcacagagctatgttatttttgtcaactggctgttgtttgtagaatgacatctgcaaaaaagcttcattgataagatggtcttatgtaatgagtagagattggttgatctggccaggcctgtatattatgttaaatttaactgtgcagactacagataggcaaatgataaaatccctatcttattaagtacaatagtttgattagtgcctaatttttaatacgtctgtgttcttagacagggttgtgtttcctacgtaactgtttatcttaaattctctccggttcttttaaaaaaaaaa

SEQ ID NO: 1877 - DNA, 2389 bp, Pinus radiata
ttgttgttatgatagaggcatctgggcttgctctgcactgctctgctctgctctggctgttcctgttcctcttcattctggttgggttggtttcttcaagggaagagaaaggaatcaatagaagggaatgcctattgatgaaaactgggtctgtatttgaggtggtggtgggtgttttgttgatagatctaatcaatcagtaactcagtctctgtgtctggttttgttgtggtgggattttgtgattcttgatgatgggtcacagtttggagtcacctaaacctgaaggcattgaaaatggtatcaagaacaagaatttatctcgctcctcatctccatcccctagtcccaatgggatgatggagattgttcgatcaaagactagcaggaaaaagtccagagtaaccagaagccagatcaatgacttccatgcaaacaccaatccggtcatgggcgatgatgaagacgaggatcaggggacggcgaatccaggtaggagaaatcgataccatgtttgcagacattgcaacagagctttcagctcgggcagagcattgggtggccatattcgaatccatggtacctcgtttaagggcgtccgtgctgctgttgctgctgttgctactgattcatctaacaattcttcatccaagtctctgttcaagggagccgaagttgacggatcggaggatgaggatgaagatgaggaagaagatgaagaggattcatcggcctcgtctcaccgtgagcaagaattgagcaatgggtgctcgcccaagatggtttctctgtacactctgcggaataatcccaagaggagtagcattctcatggatccggaattcactctggagttaacgggtagtggtggtgctaagaggaattgctggcaggaatcgaactctggtgttttcccttactctgaatccggatctgagcttaaggggttggtggctcctcagtttgggagctggtctgtgacgagaaacagaagctccagggagccgaggaagcagaggcagaggcagaggcatggtaaggaagtggcagctgatgatagagatactgcgaatttgctggtcatgcttgcaggaagggctaatggtgaaagggaatccactgaggagtctgtgtatgattccaagactctgctggtttcgaacctggaatctcagggaagtattgaggattcgggctctgaggaagaagcgagaatcttgcagaaaaagaaaaggaagaggaggccgaggaatgggcatgagggtggggaagttgggaaagaggatgagttcgatgtgggaaaaaatatacatcgctgtaacacatgcaagaaagtgtttaattctcaccaggccttgggtgggcatcgggctagtcacaggaaagtgaagggttgctttgcagctgaaggtaaaggggaaggtgaaggtgaaggtgaagggagtcttatgatggaatcagatgccgctggcaatactgctgggatgaatgatatttggcctcctccaaaggaagaggaaggaggaggtactgtgactatgactatgagccacttgacccaagaagagagccccgagcagcagcaacagcagcaatctttctctcaaaagtcaggcaggcctcaccagtgctcaatctgtcaaagggtatttctttcaggacaggccttgggtgggcacaagagatgccattggatgggtgatagagttacagaaactgcaaccagtgtgatttccaagcaggaatcaggtggcagagtaaggaattggagaggagaggagttgctggacctgaatcagccaccgcctgtagacgaggatggcctccgagctgcctttgacatgtgacctggtggaatgtggttcttgctttgtgctcaagatgcgaaccatgttacaagcagataatacagttgattctttcattggggcaaataagggatcatggcaacctactagatcttcttcttcttcttccttcttctattttgcttctgctgctgatgctgatgatgatggcggtggtaatttggattgaatgagaattgcctcaactgaattgcctcaattgagtgagaattactcattaggtatgtacaaaaaaacatttatgtttttgcttatgtagttacttgtttggacttgatcaatgaagtaagtgacagacagacacctccaagggaacatgcatatgccatctttgtgactgttggaacttgctgagtaacttggctatcttctgattcaagccattttgacgcttactgttaaattgatgtaaaatctgagataattcctcagagatataccgcattggcagctgttgatatagcatagatgttatttgagattgatttcaaggacctgaaaccaagatttgatttcaatcc

SEQ ID NO: 1878 - DNA, 2046 bp, Pinus radiata
cagaagtgctctgagctttccggattttccagacatgagctgtggctatgagagcaatggagatgccgcggcttttgtgcagaaagatgcgcggggcgagatgccaggcattcgtcttaataacgcatttgtgggctctagttcgcctcggctggaggatgtgttttgtgccctgcagaagtatttgccttctaataatgaagatgaagagtctttgcctgctgtggatgcttattcctgcgacgaattcagaatgtatgaatttaaggtccggcgctgtatgagaggacgaagccatgactggactgagtgcccgttcgctcaccctggtgagaaagcaagaagacgcgatcctcgacgctttcattattctggaactgcctgcccggacttcagaaaaggaacctgccgccgcggggatgcctgcgagtttgctcacggcgttttcgagtgctggctccatcctgctcgatatcggacccagccttgtaaagatggacggagctgtaagcgcagagtctgtttctttgctcatactccgcagcaactccgcctgttgccagggctttcatctcccagcagcaattcaagaagcagtacggcgctgcatgttgcttctgctctgaagaactattctctgtcagcctcggcagcagcttatgacggatcaccgcttcggcaggcgcttgaaggaatcgtgagttcgagtacccccggcggatctctgatatcttccccgacttcgacgttggtggggcattcccagtcacctccgcctctgtctccaccactgtcaccatctgcgtctccgcccctgtcgcctgaacctggctggtctaatacttacagagtcggtcttcaaaaggctgttcttaacagacaaatccctggacaccgtcgtcatgtagagagaattgcctcaatgccttctgaagcctcaagagggttggtaagcccaaggcttatgactttatctgatactacttcccaacagcagccaatgggggaacttattaattcactgcagagtttgaggatgaaggaatcctctgtaccttcatggctgcaagttcaaccccaaatggtcaatggtggcggtgggcatgtatctccgaggatttcgaacctgcgacattgtgtcgttcaaagcctcccctgcacaccaactcactcagaaactgccgatgatgtgggtgattggtttgaagagcctgttcagagggtcgaatctggtaaagacttgagggcaaagatatacgcaaggcttacaagagaaaatctcaatcaggactcttctccatcaatagagtcgccagatgtcggttgggtaaacgagcttgtcaagtaatggattcagggttttaggtttttcttcattcgcaggtattgatcctttgatgaattcgtaattttattttgattgtttttcatatttgtagaagttggggacttcagtggtttttactcggagccatgagaatagtgttgcatggccgagttcgccatggggaaaagaattactaaacctggggaatgtacagatgaagatgggttgacttaatcataaatttacaagttgatgtctgcttagctgcggtgcaaagtgacttgagtttttgcgagggcaatgatgtcggccctctctattttgccctggccaacatgttgcacatatattttggcagatggtatgtcgctgactgggcagagcctgccttctgttaattttttggggatgtagcttaacatcctatgatgctgtgatatataacattattaataatcgatcgatcgtcatattagccatagtagtgaatacttccattgtatgggtggattaataacgcatccatccattttggtacattattttgctagatagaatagttttctgtacaggaagcatagcacatagggcagtcgagtcaggttaggtgactgcttggtacagaccagcagtgcctgccattgtgtaaaaacaatcatcattttccattcatttggattttaatgccattaatgtgattatatatttcaaaaaaaaaa

SEQ ID NO: 1879 - DNA, 3610 bp, Pinus radiata
tgtttccaggcgggcactaaagcaagggagggggtaggctttactttctgctctgcgcaaagaacgttgaaatcaatcgccctggctggtctggcgtgactactagattcaatttcttcatggccgtcttcacatacccattctttaccggttcagagctgtgatctttatttttaacagccacaatcatggtttgtgtttccagtgttatgatctgagtgaagttcgttctttttctcgtgacccaggcttgatactaggccggacctttctgaggtggaagagatctatacatttgaggcctattttgtgtagccatgtgtggaggcccagaacatttgaagcctgccagcccacacgaaggagaagataaagtcaaaatggccgagaatcagtctatcaaagtgaaggaattgtctgaatcttgttcaagtctacatgaactagctgctaataatgaccttattggctttaagaaagcaatggaggaagaagggtcaaagatagatgaggttaacttttggtacgggaggcagaatggttctaatcagatggtcctggagcaaaggactccattgatggttgctgcactttatggcagtgtagatgcgctgagttacatcttatccatttatgtaacttgtggagcagatgttaaccaagcctgtgggtcagataactccactgccttgcattgtgcggctgtgggagggtctgcctgtgcagttgaaactgtaaaattgttacttcatgcaggcagtgatgtgaatcgcttggatgcttatggcagaagaccagcagatgtgattatggtttctcctaagctaaccgaaatcaaggccaagctagaagaaatgttaaacgcagctggttcatgtcaaacttctccggcaaagttgcctaacatagtttcagggccacctgggtttgagtcaaaggggatggagtccatgtccccattgccattgttgcctctttcattgtctttagaagcatccaataatagatcaggttgtgtgaattctccaacatcttcgccaaagtccatggaagcattaaagggtttcggtgatgttaatgagaagaaggaatatcctgtggacccttcttttccagacataaagaatagcatctatactacagatgaatttcggatgttttccttcaaggtgcggccatgttcacgggcatattctcatgattggactgaatgcccatttgtgcatcctggtgaaaatgccagaaggcgggatccaagaaggtatcattatagctgtgttccttgcccagattttcggaaagggacttgtaggcgcagtgatgtttgtgaatatgcacacggtgtttttgagtgctggttacatcctgctcaatataggacacggttgtgcaaagatgggactaattgttcacgtagagtttgcttctttgctcacacatctgaggaactacgccctctcattgtctctactgggtctgctgttccatccccaagggcatcatcatctctggacatgacatctgtcatgagtcctcttgcccctggttctccctcttcagtttcaatgatgtcacccttcctatcaaatcctcagcaaggcagtgtgcttactccgcctatgtctccatcagcgtcctctgtaaatggatatggaggctggccacagcctaatgtaccaaccttacaccttcctggtagcaatgttcaaaccagccgtcttagagcggaacttaatgccagagacatgcctgttgaggattctcctcgaatttcagactatgaagggcagcaactcctgaatgatttttctccactgtccacacaagccaggctgaatgctgctgctgctgttatatctggtggcgggaacaccacaacaaggtctggaaaatacaagagtcacgggatcaatactgttgctccaacgaatcttgaagacttgtttgcctccgaggtaacatctcctagagtagcagttcttgaaccttccatcttttctcagatgagtccccaaatgcaagctcataagactgcccaggcatatatgcagattcaaaaccagatgctgcctcctataaatacacaggcattttcgcagggaattacacagatgcagcaggctgcaatagagcctcagagccctggacattctttgatgcaatcacctttccaatcttcctcgtatgggttgggatcccctggtagaatgtcacctcgttgtgtggatgtggaacgtcataatacatgtgggtctcccttatcaccggctatggctgcaacgataaattcaagaatggctatggctgcttttgttcagagggaaaaacggagccatagttcccgtgacttgggagctaatgtgaatcccagttcatggtctgattggggctcgcctacaggtaaagttgactggggggttcaaggagaagagttgagcaaattaagaaagtcggcttcatttggtccccgcagttatgaagaaccggatttgtcttgggttcaaacactggtaaaggaaactacaccagagggtaaagatggaggaaatgtaagctgttctggggaaactccacacaaggggcaaatagaaaatgttgatcattcagttttgggtgcctggattgaacagatgcagcttgatcagattgtagcttgagattaggattatttatttggagtggtggtagggataggctcatttaaaattcaatttctcattttttactatttcttttataaaaattccccattatagtttaggaaatagtctggttttctacctattatcagaattacacctgcaggaaattttggaggaaagcatgcaaaaagtagatagggatgttattcctatcagcaggttgacaagctgaaaatcacttgggtggtagaccagagaatgacactattttttgttgacatggcaactgaagatgctgttttctttacttatcattaacaaccctatatatatttgttttgaaagaactgagcggagaaatgttgtcagttggttactctgcgcaaggccttggaagaaatccaagatgtggcatcttggtgcatttttaatttatcaagtgtgaaatccataacaggtttcagtgagtgacttctgaggttgtatatggaaaaacctatgatgttggctgtctactgctatttttctgtgcctaaactgtcaactaaagtttgcaggtggcaattttgtggcagcatatttgcacattgaagcggatggtctgcacctgctatagaagttttcgagtctgtagaatttgatggtgcaagatgattttctagttgatatatttggaaggctttgccaaagtagtggcatgtacattttgcaaaaatttaaaggatggcaatccattgttttgccatgtagcttcactttattgattaggtggaaaggaattttgagacacttcaatttgtgcatacttttgttctgaactgcaaaatcagtctcttgtgatgtcctcaaggctattatgctcagggatttgcctaaaaccataagtggccttagataaggtaccattgtattaccttttattgtttggatattttatttatgaaagtgaatttattttaaaaaaaaaa

SEQ ID NO: 1880 - DNA, 3347 bp, Pinus radiata
gaatccttttttagttatgagaaagtaatttgctgctgctgttgcggagctcagatctgttttttctgcagtacagctggtttgaagctgtcatagaaatctgcaatgagcatcggcgcccaggcactggactgagtctgtttttattttttcttaaaaatgtttagtgtgtcttagataggatagtactgagagtcgaaaatccttggcgcatttatatagaattcttcccttgttatgattcaaagttgtcagactgacaatggtgccgtgaaactcgtgctcttgttataggaatgccagtggttttctcgaggttagactgacattaaaatggatttgcatgatgctacgccgattgttttcagtcggattcagagcttagagccagaaaatgtgtccaagatcatggggtatttgcttttgcaggacaatggagatcaagaaatcattcgactggcctgcggctcggacgctttgttgcagtcctggatttcgaaggcaaagaaggaccttggcctcgttataacaactgcgccctataattctcatctacctcttcatcatatctcacatgttaacaacaattccctagccaggccagcgtttgcttctcctgctttggtgtctccaaatcgcccaggggcagtttattggggagcatcatctcatcttcaggcgcagcagcaagaaagacagttatccttttcgttacccacattatcattgcagccccatgaccagttgcgaatggaagatcacaacaatgtatatatcaattacaggcctaattccttgcagccacttcacatatcctccaacgagaaactgcagcaggcaactccagctgcaatatcttatgaaaagctccccaattacagccatgagcaacttattctaagagacgattatcagctcagagatcagctctccttcttcaatgattcattgaatcctcacaccatgttccctgctattgattacctattcccagatcagatggtcggttatgtgaacagtaacaaattgggtattgatcatctcaactctataactactgttaacagtgacaatctcagtctaactccatccgccattgctcctgatgttactgaatcctctccggcaccgtcttggaagccctgcatgtattttgctcgtggttactgcaagcatggcagtaattgcaggtttctgcatggatacccgaggcaagacaacacactgcctctatcattgagtggcagccctactggatcccgcaactctgatgaagcttttcaaggtgggtcattggagagattggaggttgagttgcaggagcttttgagaggcaagagagcgcctgtttctattgcttcactgcctcagctctattatgaaaagtatggcaagacactgcaggccgaagggtatttgactgagagccagagacatggtaaagctggttacagtctcaccaagctattagcacggttgaagaacactgtcaccctcattgataggcctcatggtcagcacgcgctggttttagcagaggatgcacacaagtttatgacatacaaaagtggagtagatgacttaggtggagtgaactcaggttctagacaaatatacttgacattccccgctgaaagtactttcaccgaggaagatgtttctaattacttcaggacttacggtcctgtgcacgacgtgaggataccttaccaacagaagcgcatgtttggctttgtaactttcacatatccagaaactgtgaagatagttttggcaaaagggaatcctcactatgtttgtggtgcgcgggttcttgttaaaccataccgtgagaaaggcaagcttggagatagaaagaatcctgacagaggcgagcagtacgcaaaatatgcgcctttcaatcattttgatgctaaggactacgatcatatgcatctgggtcccagaatcatggataattctgacgctataaggagacacatggaggaacaagatcaagtgattgaactcgaaagaaaaaggcttgctgagttacacttcgcagatgcacaaagggtgcatcttgcagcagctgagagccacatctcctttgcatcaacacctcttgttgtttctcacgccctcgagaatagattcactaatggattcccacagtctgaaatagaatccaaggcatcagaagatctcaacaattttccttcaaccgatcattttgggtacctgcttgaggtactggagaataacgaagatgagcctaagcaggacaatgacgatcaagaaagctatggacataatcttccagagagtccattttcaaatcttaatggatccaatattaaaacggtattatatacttcagagaaaacagtggggaacatgcccactatttccaaagctttagcacaagcatcatcaacgtctgttatcgataaggaacttacttgttctatatgcttgggtacttagaatattttttttttttacattgttatttcaatgatttatctgtattctaacaacggacaacaaaatctgaaacttctacccataaatctatgtgcagatgccgttgtggagccgaagcaattagcgtgtagccacttattttgtttgaaatgtgtgccaaaggtaattaaattgtctgaggagtgccctatctgtgtgcaacacaagggcaaccaggtctttaaactttctggaaggagagatttacaatttgattattacttgggaaagagagccagtcccacaccaaatgtgtggtagttatacaaaatatacatcatgatacttagcttggtccatttctcagatggcaccgggtctaaaatataaaacaatttgaaaatggtgcaaatgcaatcctttgtacctatatgaagatacagataatgtacacagtgccccgggatgcatcaaggttctgccctggggcctgatttatattttgtttttttcgactgagatctgcatccccactgaattgggattttcaaattgagcaggcagccaggaaatttgtctacatataactatagaaaattcagaagataccaaaaatagtatagtttacagggaagtgttgggtatttttaccttagggaataattattacctagtctagtgaactactgctgctactactgctattacttgcagttatagaaaacaactatagccgtgatcaagttgtaattcttcagtatagaaaaatgtgtatagaaaacaaaaaagcatagaagaattatgggcgagctccctttcattgtggctcgaagtatcaattgttataaaaagtctttgaatagtacaatgaatgacgataagatttttcactaaaaaaaaaa

SEQ ID NO: 1881 - DNA, 3385 bp, Pinus radiata
gagggtttttatctgctttttgatggtcctctgaatgtattaggtctctgcaagatgtgtggaggccctgagcactttaatcccagggtggtacgacagtagagcagctggttttgatgaagaaaatagtgttagggctggtgagaaactggacagtggtatgaaagaaatggccgagtactgctcaccagcgttgcttgagctagctgcaaataacgaccttagtgggttcaaacaggctgtggaagaaggtgggtcgagtgttaatgagagaggcttatggtatggaaggcagattgggtccggccagaagatggttttagaacagagaactcctctcatggtagcagccctttatggcagtttggatgtgttgagctatatgttgtctggaggcagagtagatgtgaaccagtcatgtgggtcggatatgagtacagctttgcattgtgctgctgcgggtgggtctatactcgcaattgaaactgtggggatgttgatcaaggccggggcagatgtgaatttcatgaatgccggtgggaggaagcctgcagatgtgattatggtttctcctaagcttgctcattttaaaaacgtgttggaggatttacttattatgggttcaaactctccaatgaagattccttgcagggtttctggttcaggattctacttgccagagggtggtgggtgcttttttgacgagcatggatgtgtagtctctgtgcctacttcgtcgcctctcttttcatcccctgatgcaacaagccctgcaactgtcaattctccattatcatcacccccaacgtctttagacactccaaagaatttgtgtgattgcggtcagaagaaagaatttgcagtggattcttctctaccggacatcaagaatagcatctacagcaccgatgagtttcggatgtattcttttaaggtaaggccttgttccagagcttattctcatgattggactgaatgcccttttgtgcacccgggtgaaaatgctcgaagaagggaccctagaaagtatcattatagttgtgttccttgccctgattttcgtaaaggggcttgtaggagaggtgatgtttgtgaatatgcacatggtgtttttgaatgttggctgcaccctgcccaatatcgaacccgcctttgcaaagatgggactaattgctctcgcagagtgtgcttttttgcgcatacccctgaagaattgcgtccgttgtatccacctgcttgttcatcaatgctttctcagagaaccaccatgacttcatcagataagatggccgtcatgcatcctcttgcacctggatctgcctcttctgtcttaatgatgtcttcctccaattcttcacaaagtagtttccctaactctccagtgtcaccattgtcatctgcaaatacatcttctcattcttcctttggtggtggatcttgggcacatccaaacttaccgactttgcacctttcaaatggtgctctccaagctagtcgcctgcggacagcagttaatgctagagacatgcatccagattgttcgattgaaagtggtgattacgaaggacaacttctgaatgaatttgcttatctctccacccaagctagaggaaatggtcctatggctactgtatctagtagtggaaatactccttgcaggcctagaaagttcagggctcataatgttgctccaactaacctcgaagatttgtttgcgtctgaagtcttctctcctaaaatgacagcctctgaatctgcctttctatctgagattcaatctcacaaatcagcccagttatctccacagcttcagagtcagatgctgtcctcatttaacacacaagtatatccacaagggagcacacaaggccaaatgcatatgcagcatggcggcgtagactgtcagagccctagtgtttttctttcaccacctcctgttcagcttgcttcatacagcttgtcatcccttggtcccctatcatctcttacgggagagttggaacgccaaaactctaatgggtctcctttgtcaccgattatgagtacagctgcagactcgagggctgttgcgttttcccaaagagacaaaggaagctctaggtcgggagaccttggaggtgctacaacttggtcagaatggggttctccaactggtaaagtaaattggggaattcgaggggaggagctacagaaattcagaaaatcagcttcttttggtatccgaagttcagatgaaccagatttatcttgggttcagaaattgttcaaggaagcaccaatggaatcaatggatcgagggactatgggtcgctctatggatatagctaacagtgtacagatggaggctactgacctaggtggctggatatctcagataaatcctgatcaagttgcccctttaacattgtgaatacttgatggtagcatttttggcgacagggaatggtatcatatgatgatgatgcattattttcatttgtttatttctatatagagattctacaatttccttcctttatccatcctttttgtacatgaaatctgggaagttgaagataaaggaagatttgttgatgtcaacatttttgtatagtatttgtattggaagtgccagtgatgggaatgacgaaaatggtcaatgaaacaggccaaatgatgaattggtttgttaaacatccggcgcggatcttttggtttctgctcgtaagttgctttatatgtaggttcatacacaaagttttggaggaaagcattcctgagtggtgaagctgtgcccttgcaagaaactattatttgggcttgacagtgttcaatgcttttaacatgctgtatgttccagatttcaaatatggtaaatttgtaaagatcagctgaaactctttatcaatgacacccccctctgttttttgtcaataatatgtggtttacaggtggacctttgaggttaaatctctgctcgccgtgttgatgctgttagactttctcatggggtcagttagtaattcaaggcttgcagtaactgatattttcagtgggccctgcctaacatgacatgcatgctaatatatttgctgatatataaggcgttttttatctctcccttgctggttttgcaatgacctgatggttgggataaatcttcccaaaccgaatcctagtggtggtttgggttaagtgatgagaactatattggtagctcagtgttaaactctgtagtggcttattatttaatatgtaaataagtttggttttttgaaattgccaacagtccgatgtgtattgtcttgaccatacccagcgtacactcttccattattactgtggttgtatcttcgtttgacatgcaattaaataactggttgatgtactttggctaaaaaaaaaa

SEQ ID NO: 1882 - DNA, 3364 bp, Pinus radiata
taggctttactttctgctctgcgcaaagaacgttgaaatcaatcgccctggctggtctggcgtgactactagattcaatttcttcatggccgtcttcacatacccattctttaccggttcagagctgtgatctttattttcaacagccacaatcatggtttgtgtttccagtgttatgatctgagtgaagttcgttctttttctcgtgacccaggcttgatactaggccggacctttctgaggtggaagagatctatacatttgaggcctattttgtgtagccatgtgtggaggcccagaacatttgaagcctgccagcccacacgaaggagaagataaagtcaaaatggccgagaatcagtctatcaaagtgaaggaattgtctgaatcttgttcaagtctacatgaactagctgctaataatgaccttattggctttaagaaagcaatggaggaagaagggtcaaagatagatgaggttaacttttggtacgggaggcagaatggttctaatcagatggtcctggagcaaaggactccattgatggttgctgcactttatggcagtgtagatgcgctgagttacatcttatccatttatgtaacttgtggagcagatgttaaccaagcctgtgggtcagataactccactgccttgcattgtgcggctgtgggagggtctgcctgtgcagttgaaactgtaaaattgttacttcatgcaggcagtgatgtgaatcgcttggatgcttatggcagaagaccagcagatgtgattatggtttctcctaagctaaccgaaatcaaggccaagctagaagaaatgttaaacgcagctggttcatgtcaaacttctccggcaaagttgcctaacatagtttcagggccacctgggtttgagtcaaaggggatggagtccatgtccccattgccattgttgcctctttcattgtctttagaagcatccaataatagatcaggttgtgtgaattctccaacatcttcgccaaagtccatggaagcattaaagggtttcggtgatgttaatgagaagaaggaatatcctgtggacccttcttttccagacataaagaatagcatctatactacagatgaatttcggatgttttccttcaaggtgcggccatgttcacgggcatattctcatgattggactgaatgcccatttgtgcatcctggtgaaaatgccagaaggcgggatccaagaaggtatcattatagctgtgttccttgcccagattttcggaaagggacttgtaggcgcagtgatgtttgtgaatatgcacacggtgtttttgagtgctggttacatcctgctcaatataggacacggttgtgcaaagatgggactaattgttcacgtagagtttgcttctttgctcacacatctgaggaactacgccctctcattgtctctactgggtctgctgttccatccccaagggcatcatcatctctggacatgacatctgtcatgagtcctcttgcccctggttctccctcttcagtttcaatgatgtcacccttcctatcaaatcctcagcaaggcagtgtgcttactccgcctatgtctccatcagcgtcctctgtaaatggatatggaggctggccacagcctaatgtaccaaccttacaccttcctggtagcaatgttcaaaccagccgtcttagagcggaacttaatgccagagacatgcctgttgaggattctcctcgaatttcagactatgaagggcagcaactcctgaatgatttttctccactgtccacacaagccaggctgaatgctgctgctgctgttatatctggtggcgggaacaccacaacaaggtctggaaaatacaagagtcacgggatcaatactgttgctccaacgaatcttgaagacttgtttgcctccgaggtaacatctcctagagtagcagttcttgaaccttccatcttttctcagatgagtccccaaatgcaagctcataagactgcccaggcatatatgcagattcaaaaccagatgctgcctcctataaatacacaggcattttcacagggaattacacagatgcagcaggctgcaatagagcctcagagccctggacattctttgatgcaatcacctttccaatcttcctcgtatgggttgggatcccctggtagaatgtcacctcgttgtgtggatgtggaacgtcataatacatgtgggtctcccttatcaccggctatggctgcaacgataaattcaagaatggctatggctgcttttgttcagagggaaaaacggagccatagttcccgtgacttgggagctaatgtgaatcccagttcatggtctgattggggctcgcctacaggtaaagttgactggggggttcaaggagaagagttgagcaaattaagaaagtcggcttcatttggtccccgcagttatgaagaaccggatttgtcttgggttcaaacactggtaaaggaaactacaccagagggtaaagatggaggaaatgtaagctgttctggggaaactccacacaaggggcaaatagaaaatgttgatcattcagttttgggtgcctggattgaacagatgcagcttgatcagattgtagcttgagattaggattatttatttggagtggtggtagggataggctcatttaaaattcaatttctcattttttactatttcttttataaaaattccccattatagtttaggaaatagtctggttttctacctattatcagaattacacctgcaggaaattttggaggaaagcatgcaaaaagtagatagggatgttattcctatcagcaggttgacaagctgaaaatcacttgggtggtagaccagagaatgacactattttttgttgacatggcaactgaagatgctgttttctttacttatcattaacaaccctatatatatttgttttgaaagaactgagcggagaaatgttgtcagttggttactctgcgcaaggccttggaagaaatccaagatgtggcatcttggtgcatttttaatttatcaagtgtgaaatccataacaggtttcagtgagtgacttctgaggttgtatatggaaaaacctatgatgttggctgtctactgctatttttctgtgcctaaactgtcaactaaagtttgcaggtggcaattttgtggcagcatatttgcacattgaagcggatggtctgcacctgctatagaagttttcgagtctgtagaatttgatggtgcaagatgattttctagttgatatatttggaaggctttgccaaagtagtggcatgtacattttgcaaaaatttaaaggatggcaatccattgttttgccatgtaaaaaaaa

SEQ ID NO: 1883 - DNA, 2148 bp, Pinus radiata
ggatggtgcatgattgatggaatgctatttgtgcagggacagagagagggagagagccccttttctttcaccacaaccacgcacggaggccttcagggctcctacactgatggtgagcgaacaatgcatgataattgtccccttagttccagttccagtccaagagtgcctggagacgctctcgaagaaacagtgttacaaatttcaattcagacactcgataccctggaggagatcggattttattcaggtccttatccagagcgtccgggtgaacaagactgtgcatactacatgcgcacaggtctttgtggttatgggaggcattgtcatttcaaccatcccccgaacgtaaaactggatactcaatatatgagtgaacttccagagagattcgggcaacctgaatgtaagtattttatgaagacaggagcatgtaaatatggtgcaacatgcaaatatcatcatccacatgacagagatggaccaagagtacagctaaactatctaggacttcccatgcgacagggagagaaagaatgtccatattatacacgcacaggatcttgcaaatttggagctacctgcaaatttcatcattcagagcccactgcattgctgcctgattcaggttctcctgtatatgcggcagcagaattgcctttgtcacctgcatcaggatcatcatatccagcaggactcacatcgtggttcttacagggagctccttatgtctctgatcctcacctgcaaggatctccaacatacatgcctgtcattctttcatctcaacaaagcacaccttcagtccagccaggctggaatacttgccatggtcctacaagccccttgtcatctccagaaggaaagcaacaacttggagctggtactgtgtatagttcgtcatacatgactgattcatcttcatctccagaaggaaagcaacaacttggagctggtactgtgtatagttcgtcatacatgactgattcatcttcaagtagtcatatgcatggtgctctttcttcccctgtacagggatcatctacagccatggaacacccaggagtccaatgtcaggttgctgctccacaaagggaggcattccctaaaaggcttgatcagccacaatgtcaacattacatgaaaacagggtgttgtaaatatggcacaacttgcagatatcacaaccctcaggagagagttgcattatctccttgttgcatgcttagttcacaagggcttcctttacgacctggccagccaacctgcccattttacagcaggtatggcatatgcaagtttggaccaatatgcaagtttgatcatccgctgacaggtcccaactgtaatcctgcagctttttcgtcatctgaacagcagacaacttcatatccaaaagggggttcttctggggcacattgtcagtccacttctgaagaattttcaaagcaagatttgaaagcaacagatcagtattcaaaagctgaggaggcatccagcttaaagcagaaatcaactgaagagggtgcaggggatagattggcagcaaaatctccatctacttctggtgctgcaatttaatctgtccgtacaaaatcattcaggctaacattcaattcgatcttggtgttgattgcttagaatgttagttggatctggtatttactcctcgcagctttctaggtcgaaggatgtcagaatttatagacagcaacaattcatgcatttcattcttttctccttttcagtgtcagcaggtggactccgacaaggttgggacttgagccgtgaaacctttgtggtttgcttacagtcttctccctgtacgtgttaccatgtgtttttgtcttaatgtcaaaaaaatgagagtttgacattttggtgtgggaatgctgctttgtggtttagttgtatctcctgtcatattttttccttgtcttccatctttcctttttttcggcgggcatcttactgtcctttaggtggtctctgtactccaacaacgtggaacatttttttgtctgaaacgcagcatcttccaaggacaagcatgaactatttttacaccaaagttgagtaaggttgtcatctaggaaaattcctttactgtctacaataaacatagttaatgagctaaaaaaaaaa

SEQ ID NO: 1884 - DNA, 2413 bp, Pinus radiata
cactcggatgattcgtgtcctaactgcaaaattacagagccgatagaatgggctcggaggtttcaaacaaaccagcttttgatccgaattggtcgtttcagcctgcagtaacgtctgcaacccagaacttcaatgaagcaatgcagatgccgttacaagcaagagattcttctaatttgtcagaagccttttcagggccttatccggagcggccaggtgttgctgactgcgcattttataaccgtacaggcagctgtgcatttggtttgaattgccacttcaaccatcctcccaatcggaaacaggttcctcaaacctgtgagctacctgagaaggttggacagcttgaatgccagttttacttgaaaggaacctgtaagtttgggacattatgcaaattcaaacattgcaatgataaagcgggatctgcaggacaggcagagtttaactttttgggccttcccattcgtcagggagagaaagagtgtccattttatatgcgtataggttcttgcaaatatggggttgcatgcaaattcaatcatccagagcctacagaggaaggaatggcttcctctgtatcaagttttccagtagatgcaactacaagatcttcttcggcatcatcatttgagatgccatattcaccagcgcatctgtcaaggccttcaccaagaattccccatgctccgggtgctcacctgcaggaacatacagttaacatgcatgctatgaatccatctcctcctcaaggcattccaccaatgcgagggtggaacattgacaaccatggttctgcaaataccttgtcatcttcagaaggaaaacttcccattggagtgagtttcatgaatacacaaactgaagatctaactggtctgcaagctgtcacaaagagagatgtgttccctgaacgacctggccagccagagtgtcaacattatttgagaacaggagagtgtaaatttggtgcagcttgcagatatcatcatccaaagaggactgaccacccatccagttgcatgccaggtcaaatggggattcccttgccatctggtgctgtacgttccttcccatcttcggaagagaaaagatattatcctggagttgattttaggaatactgctgtacaatgcaataatttagctgagattaataagcagttttttccccccagaactgctcctttctcctctgaaacaatgccaccccctataatgcaaactcaggcaagtgccacccagaagcagacatttccagaaagacctggccagttcgaatgtccacatttcttgagaacaggggaatgcagatttggtgttatgtgtcaatataaccaccctaaggaatggtttgcaaagtcatctgaatccatgtttaatccaaccggccctccagtgcattatgtccctgtagctccaatgtcatcatcagaagagaagcaacacaccgctggaataggccttttaaatggtacaaaacaaactactgatctagctgtaggttctttgccttctgttcttacgtctgcagagtctatatgttctgcagccaaaacaattcctaccccacagccttgggagtttgctacaaagaaagagacctttcctgaaaggcctggccagccagattgtgcgcattacttgaaaacaggggattgtagttttggtgcagcttgcagatataaccatcccaaggaaattattgagcaatgcatgcttagtgaaatggggcttcccttgcgtcctggtaagccaacatgcgtgttttacagtcggtgtggcatctgcaaatttggaccacggtgcaaatttgatcatccaataacaggtcatactagcaatcgatcagttcccttaaattctgaacttcctgtggatccatattccagttgtacttctgccgcagatatgcaggcatcatctgcttcttcattgtcgtcacaaagatgtcaaagattaacttaggtattagaagaacccggcggcttcaatcaagttactggttgtttacaatatgctccaggactactctttgtaaatttttgataccatggttgtattctggatgtcagatgaataagtacggactgaattcagacagcatgtctggaacaagttactcgacgccaatgttgactagagttgataattggggtgcttgattgcacctttcgacattagagatggtcgatgaactagataattagagctgctgtttttttcgctttgaagtcatttttatgataggcttaaagatctaattgctgtataatgtctaatataaacttgattgtgcaagtggtgctggatatctttttgtagctaagtcttactttatatgtcatgtttcaccgagcataataataagtggctaattccagattttagtgttagaactgacaaaaaaaaaa

SEQ ID NO: 1885 - DNA, 1082 bp, Pinus radiata
gtccatcggaggttacagcgattcgaaggcctgaaaaccctaaaaatacctatccccctttgtctttgaatggcagagaactatggcagcccggatagcagcccccggtcggagaacgaatccggcggcggtcacatgggcggcagcgatttctctgtgaaagagcaggatcggttcctgcccatagccaacgtggggcgcataatgaagaaggccctgcccgccaatggcaaggtttcgaaggatgccaaagaaactgtgcaggagtgcgtctctgagtttatcagtttcatcaccggcgaggcctccgacaagtgccaacgggaaaagagaaagacgatcaacggcgacgatctgctgtgggcgatgacaaccctggggtttgaggactatgttgagcccctcaagatctatctccacaagtacagagaaatggagggcgagaaggtctctatggccaaacaaggagacccgactccttccaaggaaggtaacaacgccattaatggctcctcaattgaaaaccctaatgctaatgcctacagtggtttgaaccccggcggttataatagggtacagtcgcagtctctgccacatatgcagcaggctgcctatgggcaaccgccaggtggaatggtctatggccaccacggccacattatgggggcttacaatatgaccgccccaaatagcagtggtggaaatagcagtggtcagcaacagcagcaagcccccagaggccaatggtagaaatatttactttttcttttctgtttttctaatttttatgggtcatgtggggacagctggtgccttagttaaagtagaatggcatcaccaacccaaccaattctttactagttgttggctgaaatgattccatctgttgcatattaaagaagcccctcaagctcaggaggggactttgaagtgctaaagaagtctctcaagctcagaacactggaaaaatgggcgggttgttgttactaactgttctgtaaaaatttaccagaaatgttgttcaaattgtctgtatttagtaggtactgaatcttaatgaatctgcttctgtaaaaaaaaaa

SEQ ID NO: 1886 - DNA, 2230 bp, Pinus radiata
agaagaaatggagttgcaaacccttgagctcagtgcacgggttacttgaagaggggtaagaagagcagtataaaggaatgccgtaggttttgtaacctctatgggccatttttaggggggaatttacagaggtggatttcttggttttgattttgaacgatttcgttcagattttagtgttcggggttttgatttcaactggcggtggcctgttttcgtccgagtcaggggttgattccggtttggcattttcttggaaggcgatgtagttcgaatgcccttatggagcgcggggacgtgacggagagttatacattgtacatttcagcttgtatatggtttctgtggttatttctgtcggtgtttaatgttttggttaagagttgcagtttcagtttttttgaattatttccgtgacacaaggacagtgtgggttagtggatgttagtgtagaactgattgtaaggtgtctgcactgaaaaaaagtgcctgtagtatgaccgttcgggaatttttgcaaagagaagaaggttctaaactcatcatgcaaggcgctgactgtaaagagcatagagaatctgaggggcagcccaatatatcatctgctgttcctgcgatgccatggtggaatgggtttgggtctcagtttccccagtctgcatggtgtgctcctgtgaagccattattcgtagatcacccaaacagagttccgggtcctgtaaaacaagtggcaactcaatcacagcagctggaacaaccatcaactcaagttgctgttcagtcgcagtctgaaggtgaagctatgttggcaggaacaagaagaatgcccatgtcaaaccagttaggttacagtggagctaatggtgaaaaacaacaccaacatcagcctacaaaatctataattggttcagccccaactgaatacctagtgccacatgcacagttggacttcaatcattctattgcttgtgctgcatacccatatgctgatccatattttggaggtattttggctgcttatccagctcaagctatgattcatcccaacatgcttggggtgcaacaggctcgcatgcccttgccattggatatgacagaagaagaaccagtatatgttaatgctaaacaatatcatgggattctcaggcgcagacaactgcgagcgaaggcagagtctgagaataaactgattaagaccaggaagccatatctacatgaatctcgacatcttcatgcgatgaagagagcgagagggtgtggtggtcgctttctgaacaccaaaaagttagaggactcgaaagcaaatgtggataatggaaagacaccagaaggacatactgcgcaggctgggagttcttcaggttctgaagttctgcaatctgaaaatggaaatggaaattctacccaggagctacatggtgcttgtgggatgtcaggctcagaagttactagcattgcacagtcatctgaaaatggtacaacttatcaatattctcatactaatggagcatatcttaaccactatcaacatccacatttccatatatcagcttttcacccgctctcaagtggaggcgaggaaggcagcagtgcaaaaggtgggagcataatatctggtggatcacaacaacgagttgttgtgatccagtgaagtgtgaaataagatgttagtggtgagaatctcacgtgcttggttctccgtgtcacattgactataaagataggtctcaatgagtgcgaagatcataaaatgaaacagattttataaagtcttcgcaattttatggttcagaggccattatcagtaaaacaggcaacccgtgatggtttgtttttgaatgggttgcagtttgcacaaacacggagctgccttgcatttgagattcttcttctcgtggaagcagccagatgggagagtctgttagtttgtggcatgttctgatgtcgcagattaacttttcaattaggtttggccaagaaattgacccaacctaaccgatctggtatttcctatggcaattcatccttggcttagttttaaatcaggtcatgataatgtttgaagttgtttcgtaagtaaatggcatttgacatgttttgatagactggaaggtttgtatgaaagcctaacgagtgttgttgtagacatttaacactctaataatggtaggacaatcgacctttcaataacctatagcgtgctgctgaaaactcgagactaaaaaaaaaa

SEQ ID NO: 1887 - DNA, 1313 bp, Pinus radiata
ctttctcttaattggctgatgtgatcttgctaccagggaccagcaaagtccagcagaggcggtcaaaggaaagttttttgaggtcactacttgagacacagctttctgatcatgattttgtagcttcatagctgttggcagtgactgtcacatgtgtatgtatagtggagcatggatgaaaggaaatagtctgatttcttttgggttcgctctcctgaaagctggagaacatttggtgactttctggtgcttttaaaatctgagtaatcaactttatattctctgaagaaaaaggcgtgtacaaaaaagtttttaaaacaatggagaacacgcctacacatactgtttcaggcattgatggcagtgctccagacgagcagcaacctcaggctgatcctgtgcaacaggaggctccgccacctggcatgataccgccacctgccatgactttgctacctcctgaatttgtgatgccacacactcaactcgaactaggacaaacaatggtgagagctgcatatccttatccagatccctactttggaggcattgttgcagcatatggtccacaagctgtgattcatccccatatgttaggggttccccatgctggtgttccattgccatcagatgcaattgaggagcctgtttatgtcaatgcaaagcaatataatggaattttgcgacgtcgacaatctcgagcaaaggcagagtccgagaacaaactgataaagaacagaaagccttatcttcatgaatctcgacatttacatgcactaaagcgagcgaggggatgcggaggtcggtttctcaatgccaaaaaaccagatgaggtgtcacaggaaaataattcgaatggtagtattgtacttgtatcaagtgttgataaacctgctgcagaaaagaaaaactcttcacagcagaacacagattcctagagttcaaagcaacaatactgtagtatggctaggatatgttgcaggcaagaagcagttttcttatgggaacaattcacccaataggtcaaatagtaatgactaaaaattgtgaaattggatgtgtcatagtgccaaatctacattgcagccagtttcagtttgcaattctgaaagcagcccagtttaaggggatgtttattgcagcaagttgtttcccaggcagggtatccaatatctgcttatgccatcgtcatagttttctatccagattgaaatttgtttattgtgcctcatagctagaaagctaagatgctactttactgactattctttacttaatttcaaataataattctctataggttaaaaaaaaaa

SEQ ID NO: 1888 - DNA, 1822 bp, Pinus radiata
gcaaagagagcccatccgcgcggagagtacttgcatacaataaatacgggccattgtttttagctcccacttcacccaattcacaaacttgccatctgttgatttgtcgtgaacagcagaacgcagaagcaaccatgaaacgagttcatcacgttacaggctaagaagggaagaaagtaaagctgctgcataatacgatttgagttttggagtttttctccaagaaacgcgcatccacagtttgaagaaataaagtcgtgaaaggcgaattatttatgatgcagaacgtgactacgaaactcggtcctgaaagcagtcaaatagatgaacagcagaaaccaccaattcaacaacagcaggtaccgtcgactggcatattgtctgcacatgcagagtctgtgatgcggcaagctcaacttgagttaggacctttccatgtcaatttgaagacaggcaatgctttttggcaagctcaagctgcatacccatatccagagcccttctacggaagctatgttgcaacatatggggcacaagctatgattcctcctcatatgtttggagtgcagcaagctggtcttccattaccaccatcagacatggtcgaggaacctccagtgtatgtaaatgcaaaacaatatcgtggaattttgcgacgacgacaatctcgggcaaaagcagagtctgagaacaagctgataaaatgtagaaagccgtatcttcatgaatctcgacaccgccatgccttaagacgagcaaggggttgtggtggtcggtttcttaacaccaaaaatgatggaagcaatgagaaagatgtgtcaggggataatgattctcatgattctacaggtcaaagtaataaggtgctaaatcctgattcaggaaaggatggtacctcacatgatttgaatgggattcaacacataggtaatttagcaccaattggcaatggcatcagtgctcattctggaacagtctctcctggtcaagttggagtgggtgaaagtgtgtcaaatggatcacattacacatataatcaaaggcgaggatttcattcatctgcatttcatcctctttcagtcagcactacagagagtggccaagttggaggcgtggtttccagtggaggccaccatacagcagtagcaacccaatgatgtcattttaaatggggttatcaagatgtatgtcctgctcaatctccaagtttcttgacaaacaaaatagatatttattgacttttgtaaaaaatatccatgcatagtttgagtttattttattagatgttcaccaatgaaaggttggtctgaagcatgtcatatcctggcatgcaacttccttgacaagacattttgcaaggaaagggtaggttttggcatacatctgaagttaaatttatttatttcagaggctgatacttttaccagaccttagatgttgaactgggtagatttgtgtaggacttgggacaccatatcaactaggctgtagatttgtgtggtgtgaggcagggcagaactctgtcagcctggattgaaaatggacagaggcaaatcattcttggctaatgtatttggtactttaacagttcttgtatttaaccaagttgtgctgactggttttatttttgcttaaatcttctttagaatttgtaataaccataagttagtttagatgccaaaatatggtgcttttcctttgctcttctctctgtttagaaattgatcgaaggataagagtttattgcagtttgcaatctcttaaggatgttatgttcagctgcaagttgcaacaatggacatctattcacataaaaaaaaaa

SEQ ID NO: 1889 - DNA, 2361 bp, Pinus radiata
tttccggtcccttcttcgatgtccgtcaatttggctgcctcattctgaaatccgtcgcaccgatttcaaaggcagctgatgatttctgtcaggaagacaggcattcgctggagattttaactctgtattggagacgactcgactgacagatcgatcggcggtagtcgatgtttcctcagcaaggaggaggaagagctggaggaggggtggtatccccgcctggaggaggcgttaaacaggagcagcagggggacctcccttcaaggaaatccgtcagacaacttgatttcacctccacctccatgtatggagattcctccacttcttcggacacagccctgcgtacatcgcaacagccttcgtctataaagcaaggatctccaagagggtcgttctcaggaccactaactgattcaaaggaaggaactccaaagaaatcaagacagtgcaattgcaaaaattcccgctgcctgaaattgtattgtgaatgcttcgcatctgggatatactgtgatggatgtaattgtgtgaattgttataacaatgttgatcatgaaactgtgagaagagaagctgttgatgcgatacttgagcgtaatcctaatgcatttcggcctaagattgcaagcagtccaactcctgttcgagataacagggaagatatgggagagcaacttcttccagctaaacataataaagggtgtcattgcaagaaatcggggtgcttgaagaagtattgtgaatgtttccaaggaaatattttatgctctgaaaattgcaaatgcattgattgcaagaattacgaaaacagtgaagaaagaaaggctctctatcaaagtgatattaccggaagcttaaattatcctcagcctgtatcaaatgcttctgtgtctggaacaactgcacctgtaggttattcgtctccttctcctagcaaaaagaggaaaactcaggaagtcctatttcatcaaacaccaaaggaacatgcttctcgccaaacatctcaagctctacagggaagtacaatgaaaaatatatcttctacagtgaatgcttcaaatcctcccctctcaacagttaatggaactggagctttggggattccatcatctaaggttatttacaggtctcttttggctgatgtggtccagacagacactgttaaaggtctctgccaacttcttgtcattgcttccagagaagctgcaaatgcttgtggagctcaaacaagtttggaaaatggacctttggataagcaagcagccaagggaaacagtttgacaaataacaaagactcccctgaatcatcaactcagaatgagtttcgtagtgaacagattagagatgacaggttggagactgaccgagggtacaaggttgctgctggtgcatcatctactaactgtgctgaagaggcagaatttgacagcggtgccaatttttctaagcaaagagccatgtcaccaggtactttagctctgatgtgtgatgaacaagatactctctttacagccccgtcttcaccctctggtggttgtaagaagccttgtagtcatcatacaacacaaacatttgccgaacaagagagaattatcctgtcagaatttcgtgactgtcttcggagtattattgatgtcggcaaaagaagagccacacagtattcaacagaggcagcaatgacaatgaaaaggaaccagcagcctgatttaaatcctcaacttagcaggcctgtacctgtgagcaaaactgttacagttcctttatcggtgccaccgtcagctagttcaggggccttagtgacagaggtaaatgccagttcctctggatcattacgaaatggagacaagtctgatgcggtggttacatttcaacagaaattatgacataagtgctagttgatatagggttagaaatatgttcaatttcatcatgaatgggaagtgataatgatccctttccagttgaaaagtaataaatgctgtaaagtgcacaactggaacaaggtgtttcttttaggcatcataatttaatttcaacaagatatgatgttgatcgaaataattcctttttggaatgatttttatgatgttattaagcattgtcagttctgcacgacagattgctttgtcctctgacctaaagataagtgttggccaagttttttgtgcctccatctgtgaaaacagaagctgactaactaaatccaccagtgctgttacaatggttggacataatccaggggaacacttagatagttgttagtgcagaactgatcccttattatattcttttctgaatccgcatgcttcatatgtactgtttaattttgtaaaggaattagttcttttttcaaaaaaaaaa

SEQ ID NO: 1890 - DNA, 1939 bp, Pinus radiata
taaaagagcgtaaaaggaaatttacttcaaaggtggcaagtttcccgggagctgcattttgtttttatggtttcccaatgcgagaaattgtgtcctctgcattgccatgagtagtcctcttggactgccatcccttccattcttattctccacattatatattggatggatcagttagctatttatagcttcaatatcattatcccgaagaacccaattgcagatttggccaacgaataggaggagaatacagaggcagtccttaatttgaagggcactttggtggttgggtgggtaggtgtctctaatatcaaaggctctttggagggcagctgaggttttgagagcactttggtgggtaccttggcgaatggcataatcatcatattacaacatgttgcctcgaggttccatccgcagggcaactggaccaagaagtggcatcaggagcagaagaactgcagcaaattcagttgtttcagattctccatacaacaataacaatttacggaaggacatctctattgagttccatgaagctagcatccacaaatatgctgaaggctttggcattactcaaaatggggcaaatgctaatggaatgaatgttgatggaaataaatcaacactacagcaaggggagggagaatatccttcaaatgcaattgctggtagatgttcaggaacttctgcaagtgcaccagggcaatcaatttctgtggaaagtggaagtggtggctctctatcaagaggtagtgaggcagcaattgcaacgccttccagaaacaatcagatggcaagggtacagcatttagatattcatcaggaggacttagattctccagagactgcaggcacaaggaagagaaaaagagttcctagagtcaatggtggggagaagggtgggaggggactccggcagttcagcatgaaagtcagtcagaaggttgagagcaagggccggaccacatataatgaggttgcagatgaacttgtagctgaatatgcaaatctggacagcactcttgtttcaccagaccggcaacaatatgatgaaaagaacattcggcgaagggtttatgatgcactgaatgtacttatggcaatggagataatttcaaaggagaaaaaagaaatccattggaaggggttgcctaagacaagtataaatgatgttgaacagcttaaggctgagaaattgctcttgaaaagtaggattgagaagaaagcatcttattttcacgaactcgaagaacagattataggccttcaaaatctggtgaaacgaaacgagcatagatatagttcagggaatactccatctgggggtgtatcgttacccttcatattggtccagactcatccccgtgccactgttgaaattgagatctctgaagacatgcagttagttcacttcgactttaacagcacaccatttgggctccatgatgatgcatatgtactgaaagaaatgaacttttgtaaaaggccatttagcactggtgcagatagtggccatgaagattgctgcaatggaaccgcactcgctgaatgcaagtcacctgaatctaatgtgtgccagaatctcataccatctcattctccattgccgagtgttggagcttcctatcctatgtcttctactcctgggagaacgtactctactccacctgttccaggcatattaaaagctcgtgtcaagcatgaaaatatgacataaatgaaaccaggtgttgcttttgtgtaagtttgtatttgtaaaatttttggtgctctgagatatgttcgagctttctatgaaggtttcttcttcgaatattcgcttctgaaaagtttatctatatgttaggttttagcatgggttgtctgatacctctcatggaagaaccatgacatgttttgagctataaaagctgtatattaacacccaaaaaaaaaa

SEQ ID NO: 1891 - DNA, 2195 bp, Pinus radiata
agaaatttagtttaacattaataacatattgtttagtctctgaaatttatcggagcttattgtttttgtctgatatcgtcccctgtgctccagctgcctgcctggtattcgaatacttctaaatttccgagaacgtgtgcgacgaatccatttgcaggttgtgaataatttttttgcgggtgctaggaaatcttctctgcatatggcgtagggagctcctcagcacccatgttgccccgaggccctagcaggagggggagcagcactacggggcctagaagtggagtcagaagcagaaaggtaacattaactcagtctcatgtggctaataaccctaataacaaccgcagctacagcagcatcagcaatagcaacggtgtgcagaatgaccctattcatgaagccggaacacatggctatgctgagggcctaggcattgtacagaatggagcaatagctactcccattgggatggaaattgttgaatataatccagatgcagcaaaagaagaaggggagtatccttcaactacttcaaacggaatggttggtgggtattcaggaaacctaacatctttgccagggcaatcagtttccatggacagtggaagcaattgctctccatcaaggggtagtgatgtagtgatggccacacctggaccaagtagtgccattgcaagattacatcacttggatggacaaggagaggactttgaatcccctgacacagtgggcacaaggaagaagaaaagaggcccacgagccattggaggggagaaaggtgggaggggacttcgccagttcagcatgaaagtatgtcaaaaggtcgagagcaagggtcggaccacgtataatgaggttgcagatgaattagttgcagaatatgcaaatcctaacagtgcgctcatttctcctgatcagcaacaatatgatgagaaaaacataaggcggagggtgtatgatgcattgaatgtactgatggcaatggacatcatatcaaaggacaagaaggaaattcagtggaaggggttacctagcacaagtcctaatgaccttgaagacttgaaggcaaagcgcatgggattgcggggtaggattgagaaaaaaatgggctatttacaggaacttgaagatcagataataggccttcaaaatcttgtgaaacggaatgaacgcttatatggatctggaaacaccccttctggaggagtagctttaccatttatcttggttcagacccgtccacaggcaacggttgaaattgaaatctctgaagacatgcagttagttcactttgacttcaacagcacaccttttgagctccatgatgatgcgtatgtgctcaaagcaatgggattttgtgaaaagccatttactgatggtatggatgttactggccatgatagttttgcaaatggaactggattcggcgaaaataacatgactataactaacatgtaccggcactctttgccatctcatttgagaacaacaggtggttctttttccatgccctctgccactggcaaaaactgcacttccccacctgttccaggaatattaaaagcacgtgttaagcatgaataatgaaaatccaatatggtcatccatggcattcccttcaaagtaactctgtattagtaagagccctttttcttggggtatattttctttctagtcatgtatcctatgattattttatttattatgatatatttttagatttttaagcaacctttgtcagtcccccatgggaaaaccatatctgtttggtttgaaagaaatgtacattactgttgtataatggaaagtcaggtctgcataatacagcatgccactttcgcaaaagctgaagagattgaagcattgagtcaacttgacatgacatattttcccctctcgagatattaatctgagagtggacgtttcattttatcaagcaactgaaatatgtgtggcagtccattcatgtaccatcttgatgcttccttttattcagccacttccagtcgagatgagatgcaaatgtttaaggggtcttgggggcgttgcccatgtttcagtacttttgaagtgtaattgtaaagtggatttgctctatagcagcttactctgctttctctcgatggattgctgagaactttagttcatcttatgaaagacatttttagagtggctattttttaaaaaaaaaa

SEQ ID NO: 1892 - DNA, 1850 bp, Pinus radiata
gggaaggcgggtgtaattatgataatgctagagctggattgcagtgacacccaaatgcttttcagaaggcctcctcggatgggtatctgacatttcttcaaaacctgtgaagtggaagactgaaacagaggaacatgagatggagtccaatgaattgccatcagggcaaggatatgtagaagcagatacaggtgctggaaatacgactctttcaggcacaggtggcaggcgttataatcggtctaagcttgcaaagcgtgcaaagattggtcctcagacacctggatcaaacattggttctcctttgggcaatgctcctactccaatcagcagctgtcgttatgatagctctcttgggttgttaacaaagaagtttattagtctagtcaagcaggctgatgatggtattcttgatcttaacaaggctgcagatactttggaagtccaaaagcgcagaatatatgacataaccaatgtgcttgaggggataggactaattgagaaacgcctgaaaaatagaatatgctggaagggtcttagtgtgtcgagacctggagaggttgaagatgaagcaacagttctccaggctgaagttgacagtctcaatcttgaagaatgcaaattagatgattgcataagagatatgcaggagcgattaaggatcttgagtgaagatgacaggaatagaagatggctttatgttactgatgaagacattaagaagctaccatgttttcagaatgatacgcttatagcaataaaggctccgcatggaaccacacttgaagttccagatccagatgaggcagtagaatacccacaaaggaggtaccagattcttttacgaagtaccatggggccaattgatgtttatcttgtaagccaatttgaggagaatattgaagagatgaatccagttgatctggcaacagaacttgttccttcggggatctgtcctgcagaaggggtaactatatccagtgttcaagaaggtgcaacttttgttgagatggaatgccaaggccatgaaactcgccaaccgtgtacagaattaactagcccacaggattctgctggtggaattatgagaatagttccatcagatgctaatattgatgctgattattggcttctctcggattctggggttggcataactgacatgtggagaactgaaactaattctacatgggatgaggtgattgaactcaatccaacagattttgggattggcgagggttctccctgtcctcaaactcctccaagtagtagtgtattctaaaacttgaagaatgcatggtgcagattgctaaatgtgcacactttgaatcatctcatcgccaaagtttactagtcacgcgtgaacatgttcatcatgtcttaagatttttggcacaaatattatttatatgaggtgaagttggagaacatcttcagcataccctgagtgtatcaggagcaggcagctgtttacaaagttttaattgattatcgacctcatactgggtgggttcttgaagaaaaaaatacaaaatacaactggatttctacaacatttatctattccagtaattaatggatgtagaggcaattgggccctggctgtatccaagttattatgctacaaatttaatccgtgcactgtttgccttatttacttatgttgtatagatggaaacaacactgaccttagtgcattgcttagactgaattaaaatctggtaaagtgtgaataggataagcatttgtaaagtcgaaatgttttatgttacatctttgacaaacatttggaagtggtagcatctaatgtcaacagtatttactagtgctttaggcttccaaaaaaaaaa

SEQ ID NO: 1893 - DNA, 2709 bp, Pinus radiata
tcttgacagagaggagaagaggagatcgcaggttctaggccggcaaatcctaaagaataggagaagaggaggtcgcaggttcaaagccggagaaatcccaaaggaagtaatcgaagtcgctagattgcaggaaccagaaatgctgcaagagtggtttgagtcttgactgctttggatttgctacacactgccatgaatatgccaaagtgctgtatctttttagttggatgtttccatttacgaatgtggtgctaatttctgtggccttccctgcatgaaaactaaggcagaggctaatgttttattcatcactaattgtgatggaacagggactccctactagaagataaatattagcaggatcaatactggaagtagattttcacacttaggttttaactttttccttggttttcctccaatcagttgtaaaaatttggcacagccaatctagggtagaagttatggggatatatgatgagattggttatccaggaaatttggatctgctttctgttcctcttgaaggagattcaatgtgtgaaaatgagggtgaggttatgcatgatgatggacttagtgaggatgacattgatgtggatgagcttgagaagcagatgtggaaggatcgcatccggcttaggcgcattaaggagcaaaggaagggaaaatatcacagcgacacagcaaaacagagacagtcacaagaacaagcccgaaggaaaaagatgtcccgggcacaggatggtatactgaagtacatgctgaaaatgatggaagtttgcaaagcacaaggttttgtatatggtatcattcctgaaaaagggaagcctgtaagtggagcctcggacaatcttagagcatggtggaaggagaaggtcagatttgataggaatggccctgctgcaatcaccaaatatcaagcagaacatgcaacacctggagcaaatgagagtaacatggttgtggctcctacccctcatactcttcaggaacttcaggacaccactttgggttcacttctttctgcccttatgcagcattgtgatccgcctcagcggaggtatcccttagaaaagggcatttctcctccttggtggccaactactcatgaggattggtggccacaattaggcttgccaaaaggacaagggcctccgccttataaaaagccccatgatctgaaaaaggcttggaaggtgggggttctcactgctgttatcaagcacatgtcacctgatatagccaaaattcgcaagcttgttaggcagtcaaagtgcttgcaggataagatgacagctaaagaaagtgcaacttggctagcagttgttaaccaagaggaagcattggctcgccagaaaaaccctaatgcctgtccaccgaccaatgcttcggtgactacacatgctgggtctctgacattcagcagcggcagcgagtatgatgttgaaggctttgaagatgatccgaactctatttatacaaataatgatgtgcaggattgcaaaccacaagacttggatctcttaaattctgaggtacaggaatgcaaaccacaagactttgaccatttcaatgtaggtatttcaaatgagggagtttcagctcttcaggtaggagataatgtagattttatcagaaaaagaaagttatcacaggaatctccattggaagatcaaaaggtctatacatgtccacatgagcagtgcccatatcatgagcgccaacttggattttcagatcagagtttaagaaatgcccatcagtctacgtgtgcgtataggacagatttgcaaggcatgggatatcagagaccagaacctcaggagagtaaatccttgttttgtatatctacggggcagcctaaacagctacaagttcaaggaaaggtgagtatttttccatctgagaaggaaggacagacgacatccaatggtaatgtgaatcttaatcctcttggcactacaagttcagcaattccaactggtaatcagcagcctatcagtgaattacttgctttatatgatgggttgcatcagaataagacagcaacactagggaaccttaagatgatgaatggtcacaatcagcttgaagtgaacatgcaccctgcttcacagggtggggaagttttcaaaattacgcctgatgataacttctttgggcaaggagttattgctggaaacaatggtaacgattttggttcaaacatgcagctggtaatgagagagggcttaaaccttgatcaaagcagggtctatgatcaaccttttatacatcattgccaggaaatgaatggagacatgaaatttgtctccgcatataacaatattccaattgactatgcagtcccagagacggtttctaagtatgataattcaatatggtattttggagcatgacaagagttattatgaatatctcatcatggtacttctgaaactctgttctacaaggacatctaattctattatagttcctgaatcatatcattataggaccactcttacaaacatctacctggagtcatttttattagatagaaacctatagatggcaatcgtcatctgtatgggcactttcatgtagagaaatgacaattcaagaagatgatgatccgtcatctgtatgatttgtgcatgatgatttaggcttttgctgtgtatttggttcggaacttgtgaaagaatccttaatttaaaaaaaaaa

SEQ ID NO: 1894 - DNA, 3094 bp, Pinus radiata
aatcaattttgatcctctctggcgcagaggcatacagtctgcagattgtcgtctttacggtgcagaggagctgcaggttttgacaaggtactgtagaatccaagcgtatttcagatctgggtctgttgaaatgaaaaccagctatttattgtcatggttatgagcatttttatggtgattttgatggcgtgtagggtttagaggagaagtttctgtggatggtttctcttttttctctttggttgattctgtgaaagggatttgggggtaaagggcttcttttgaatgggaattcggtgtagaaatgcacaattctctgggtctgatctctgggtttttcatgactctaatgatggtgttttgatggagaggttgtgtggcggtgtgtgattcttaattgtgttatgttgtaagtgttgtggaatttagtttagctggggagagagagtttggagttcattttcaattgggaggagtccttgattgtatttaggctagaggtatgctttgggttttggagtagactttgggttagagaagggcttttgtcatttgggttttggttttggaggacaattttgggttggagaagaggttttgccctttcggtttgtgaggccctgtgcttccgtggaagctcctgacaggcctttcctgagtttaggaagtggaggccctgattggtctttggactacaatttaggttggataaggctgattgacatttgggtgtttcagagtcttttatttgtttggtgggtgattatggagaggccggaggagtttggtttttcgggtaatttggattttcttccctttatcacggaagcggggggtggaggtggagggggaagagattctatgggggagaatgtgggggatgctctgcgtgaagagtatgtcagtgatgatgaggttgatgtggatgagcttgagaaacggatgtggaaggatcggatcaggcttcggcgcttgaaggagcagcggaaaggaagtgatgtcgttgatgatgcaaagcagaggcaatctcaagagcaagcgagaagaaagaagatgtcaagggcacaggatggtattttgaagtacatgctaaagatgatggaggtttgtaaggctcagggttttgtatatggtataataccagagaaagggaagccggtgagcggtgcctcggataatctcagggcctggtggaaggaaaaggttaggtttgatagaaatgggcctgctgcaatatcaaaatatcaagtagaacactcagcacctggaaaagatgagtttaatacaattattgtttcaactcctcatactcttcacgaactccaggataccactctgggttctttactgtctgctttaatgcagcactgtgatcctcctcagaggagatacccgttggaaaagggtgttcctcccccatggtggccaactggaaatgaggactggtggcaacaggggggtttgcctaaaggacaaatccttccttataaaaagcctcatgatctgaaaaaggcttggaaggttggtgttctcactgctgtgatcaaacacatgtctcccgatattgcaaaaattcgcaaacttgtgaggcaatctaaatgtttgcaggataagatgacagcaaaggagagtgcaacttggctttcagttgtcaaccaagaggaggcattggctcggcaacaaaatccgaatacttgccttctcaccagtgccgaaggatttggacatgcaataactttaacatccagcagcagcagtgagtatgatgtggaaggtgttgatgatgtccctgattcagcatgtccaaaacatgatggacaaggagacgaggcacaagactttgatctcttcaacatggctgatgcaaaggacaccctttggtctattggaaatggagaagatgctagtatgaccagaaagaggaagctacctgaagagctgttgatgcaagaccagaagatttatacatgcccatatgagcagtgccagcatcatgagcgcaaaaatggatttttggacctgaactcaaggaatgctcatcagtctaattgtccttacagaacagatgtgcaaggcatggaatttcaaagactagaatgtgaaactaatgcttccacattctacacatctgtggcacaacctgatcatcctcatttgcaagagaaaggtgtttctgaatcaaaaagtggaggacagttagcatctctggggaaccaaaccattcatcctcttaatactggcagttttattatgcctcctaaaactcagcagcatataaatgagctattggctttatatgatagtagtgtgcaacaaaacaaggcttctaccaatggaacgacccagtttgttagtggtaataatccacttgaaattatcacagaacctggctttccaaaagaggatttttccagaattacaccagaagatgttttctacggtcaggttgtcgtgctgggcaacaataatagtgagtgtagtataagtatgcaccagtctagtggaagcatgcaccattctagtggaagcctgcaccaatctggtggaagtatgcagcagtctataagagaaggtatattctgtgatgaaagtaaagtatttgatcaacctttccagcctcaatcccgggaaatgatcagaaacttgggatttggattaccttgtgatgtttcctttggatctgtggaatcatttcacagaggatcaaataatagatctacaaatggagataaaatctggtattttggagcatgaaagcaagcttgactggaattaagaattttgccatatcatctctaaactgacactctacaaggactactacttttagtgcagtccttggttactgcatatcaaagattcttcatgcagtgctgtattctagcaggctgtttgaagctgaagatggaaagtgcagttaagcactcttgctttctttcttgccagttgctggtcctagaatagcatagttacactgtacttgttaattgaattattgtactcatatagtgttcaggagtaccattttgtaagactcttctttctcatcctaatcagaagctgtcctttttcaaaaaaaaaaaaaaaaaaaaaa

SEQ ID NO: 1895 - DNA, 1129 bp, Pinus radiata
ggggtgattagcgtttgtctgagatctccgggcattactctcgatttgcccatttcgcatgctgcggagctcggaaagtaactgaattctctgcaatttctggctacagtgggcgggggtatatactatatactataccctaccgcatgcgcaattaccatctgattactcttatattatgttatgtctgatccatgactcttcgtttttcataataaaaaaattgtgtgtctgcgattctcgcaatatattatagagcccaccacttctctctctggatcttcattgcaattccttttcagtgctctgggcttgtgttaatcgatcagtaattgcccttttgaggagaattgttcagtctgtcgcgacggggttgcctctgtggatgttcagcttcagaatggacgtcatacgcttgcggcagcggcttattcagctcactaattcccttttccaagagggattcctggatgagcaattcacacagttacagcagctacaggacgacagcaacccgcattttgtgaccgaagtggttgtattgttctttgaggattctgagaagttgctccataacttaacaaacgcacttgacaaggaggtgattgattacaagaaaatggatgcccatgtgcaccagttcaagggaagcagttccagcgtaggggcgcagagagtaaaaaatttatgcatagcgttgcgtacattttgtaacgacaataaccgggcagggtgtattcagtgtctgcaacaactcaaggatgaatattatctattcaaggataagctgcaggatctatttcatctggagcagcagatcttgtccgctggtggaacgcttcctatgatggagtaaacgctggaattctatacagtatgcatcagctttcggtgcaatggcgttagtaggactgggccggctaggcttcgtctgtgacaagcccatgatgttagttagcctggcaaatcggaagaaatattgtgataataaatcacatatatgagatagggttatttttgtttttgtaatggatttatttttaagagaattaagctttcatttttatcttcattgtagattttgaagatgttaaaatgaaggttgtttttgaaaaaaaaaaaaaaaaaa

SEQ ID NO: 1896 - DNA, 2582 bp, Pinus radiata
gagagagggagcaagatcaagaccttgtttagtcgcatggagaatcagatgttataaaaattgtctgagttttgtgttggtgatgtttgggttcacaagggagagaatttatcatggcaaatactgttcgcatttttttattttagcttgatggagctttggacagaaatatagacctgcttgtgactcttggttcagactcatctagtaagatcagcattgcctgtttgagagagaaatgcttctgtaatgcaggcgcagtacgctagaggcgaatatcatcccaataaactatagatctgtgtagaaatgggatcctcggcagaattgaccttaaattgtggcccttctgtaacctcggcttctaacgtttttaagtccttctccgtcgtgggcgaccatcttgagaaaatgagaaggcatgaagaatatatcaagggattggaagaggagcgaagcaaaattgaagcatttaaacgagagcttcctttctgtatgcaacttctcaacgatgccattgacgcttgtaaggagcagttggctgaatgtgaacgaacttcaccccatgaggatgtacaaaatgctcctaataccagtggcagacctgtgcttgaggaattcattcctattaagaaatcttctcaagcgactgaaaacaaacctgaggaaaatcatgtttccaagaaggcgagattcaacaacagtgataaacctaattggatgatctcggctaatttatggaacccagatcctgaaagtattgatagcagaaaagggggggggatatctatggaagaatccttaaagaagcaggattctcagcatcaagaacactctcttccttcaaatgccaaactgttttcagattcaaaacacagagtgagaggagcattccagcctttttcgaaagaaagccacgtgatcgctccccggcctgtaaggtccactgttgaaaggacattacctaatcttgctttgtcatctgctgagcgtgaagtagattcatcattagtggccaatgaaacagtctccttgaatgctactaccaccactaataacagaattagtagatccaaagaaacaaaagaggtacatacaccagtgcatgaaaaggaaacagtttcagttatcgatggggctaacacatctcccactacacctaatacatctccagctcaaacacagaggaagagtagaaggtgttggtcacctgaactgcatcggcgttttataaatgctcttcaccagcttggtggctcacaagtggccacaccaaagcaaattagagagttgatgaaggtggatgggcttaccaatgacgaggtcaaaagccatttgcagaaatttcgcctgcatactagaaggcccagtccttcaccaccgacctcaaatcctcaagcacctcagctggtggttgttggggggatttgggtacctcctgaatatgcagcacatgccgctgctgcagcccagcaagggcagggtgggctttacaatccaatacctacaactgtttcttgcccacctctgtcacattactgtcagccctccatttcccaaggccatgaatattattgccagataaatccagcagcttcaaagtcgcagcttcaccactcagtctcactttactgtgaccaacaacaagaacaacgacagcagacgccgtcacaatctcaaaactccccacaagggccctttcagtgtaatgggcaatcctcgggggctaggggaacctctgcagatgctggcagagaggaaagtgtagggaaagatgcagagtcagatagttccagttggaaggcagaagactatgttgaaactacagaggtgatgaacatgggaaggggtttgtctctcagaaaacaacctcacaaattcttgaatgaagatgatggagatgcagcagacaacagagctagagatcaaacgggaaagcaagcactagtagggagataagactttttcaaaacagtaacctcggctctattatgtgtatggaaatagataatgaagatggagaatcagttatattctcaaattagcttttcagcattttttgctcgtttggactctggagacttcagccaagctttgttggcaaagtgaattgctttatgaaaccataactattttgctagtctaacaccaagttgagtcctctccttggttttgctcttgctctccttgaatgcagctcctctcatggaaccgtatttcaaacggatcacttaattttttgagcttgagcacatatctgattaacatttattccaacagtaacatacctgattgatggtttagcaacggatttgtgtggtaaatacgtgtaaagcaaagaagacaccaagatcagctgaccttattggaaccggagctgaaatttaagaaagagatcctcattatcaatcagtgatgaagatttcccgagaattttaggctcagattttccagggtacttatatacactcgtatttcttgtaattactggtgcctattgtttgttttattttggttgtgaaagcttgtttctagctgactaatgaaatcaaatttttaaggatattggattaaaaaaaaaa

SEQ ID NO: 1897 - DNA, 2341 bp, Pinus radiata
gggaaaatcctgtcatgcgatggggaaagtggttattttgtttgctaaattcagaaagtaagaaaagggaacttgtgggctggaaggttttgtgaacagtgagtttaataagtttaacaggctgctggtcctaatacacaagctatggcatggtgaatgagggattaatgtaaaattttccgagtgtagctcccgacggttgatgatgatggatgatgaaagttgcgtaggaaaattaggagatgaatgcaggtctatcatgccgattgcaaattttactccaattggtcttaacgttttggttggggatgacgatccactttgccttctggcgcttgaaagaatgcttcgccagtgtaattacaacgtgacaacatgcagccgagttccccaagcaatatcgatggttaaggaaaacagagaccgtttcgatctgattatgagcgaggtgtatttgccagacgaggacgggttcaggctacttgaaattgtcggattgggacttgatttgcctgtaataagtaagttttacccttctctgggattagcttttcttttccagaacttgaaatctgaaacccccactagataccctgcagcatcagatttgtgaacgaacctacagattggccaagtagctggagttcttgttgaagatggtccggacattgcttgctagtttgactgtgtgggaaataggtttctaattgttattttccactgtttgctctaatcgagttgagggtctttccactttatgctctgatcgagttgaaagtctttttgtccttttatttttgtatatccaatgcaggaaattaagaagcaaacgagtttggttagttgagccatgttacaccatgtatgcccttggattattgtgtccgcagtgatgtcaacaaatggagatactagtgttgtgatgaaaggcatcactcatggagcctgcgattacttcgtcaagcctataaggatagaggagctaagaaacatttggcaacatgtagtgcgcagacgaggcagagaatctctcaaggatgacttgggagaatgcgaggatcgtgaagtaagtgattcaccagacacgtcctccaaaaagaggaaggataccagtagtggggactattctgatgaggttatagatgacattagcagtctcaagagggcacgagttcactggaccgtgcaacttcatcaacaatttgttattgcagtgaatcagttgggaatagagaaagcagtaccaaagaaaattgtagagattatgaaagttcagggactttcacgggagaatgttgcaagtcacttgcagaaataccgattgtatctaaagcgactgagtggggccatctcggaaccccacccagttgcttcgttccaggctgcagatgatagcatatctggagggatgatgaaattacagcaaggggaaaaaggtgttgcttcgtcatctggtgcaaaagggttgaatttgggtactggggtaagttcaagtttaggagttaggggactagacccaagcactctcaaatcccttcaacagtacagggcttatcagcagaaactggttgccaacagagcacaaatttttggaggcataggagttcgtcctccaaaatattctgatacagccaaggtgcccgaatccatgggaggctccaaaagtggattacaaagaatgtcctccgttgatatgggtttgctgtggaaagcccaacgtgaccaaactgcagatgagaataaaaagcaggggatagctaatttacaaaatctaccacaaaagagatcgaatagttctgaacaacggcggtttagagggtcacatcctaaacattcaaggacacgaactatgactgacttgcctatgatttttcagagtgctaaacccgaagtaactttccagaaaactccgcctgctaaaagtatgctccaggacgttgatgaacttcaacccatggaagatatttcttggcttgataatacatttaagcctgaaagtccaagagcagctgtcatttcatttgatagttttgtgcaagattttgaaggcagttcactctctgcagctaccattgaggagtctaatagacatgcctttgctagtactgactttgaaggccaaagaaaagctggagtagaaaatgaagagttcttttcgagtggatcgactgacatctcagattaccttgttgatgatttgatgcctcaccccagatgaaataacaatctcaaatcacaaccttaacagcactgtattagtgcagggcattgattcctcaaagcaatttgtcacctgtaaaattatgaaccagtagtttacgttgctgttgtaaaaaaaaaa

SEQ ID NO: 1898 - DNA, 2721 bp, Pinus radiata
gatcttaactctgccctgaaattcggggccttcgagaattgtcgcgtacccagtttctctgcgctttctggttaagcgttaaagatctttccttccggtttgaccttgtggatccgatcgctcgagggttctcggttcgattccaggtatttaaatcttaattttaccgtttatggtcaaagtttcgtgaagcggaagccgatttgttgtagatttgagccgtttcggttttcgggtgaatctggaggttttcagtaaagcataaactggttcccaaccagtttcggaaaatatgcagcaagccatgaaaatcacagcaacagacaacacagaaggatacacagcataaggaatcgtatggcgatattcataatgcctgtttggctagcagcatacagtgtgatttgatggagataaatatggcttcgtgagagtaaggaaggcgaggtactttgacgttacattttctcacagaaagttctggggttggagtcatgggtaagggcagtatatcgaatagcgacgccggaagctcggtgctcgaccggagctgtgtacgtattctgctctgcgacaaagatcccacaaattcacagcagctgttggaattgcttcgtaaatgttcgtaccaagtaactgctgttagtacggctagagaggtcgtaagtgttctgaatacagaaggccgagaaattgatctcattttggctgaggtggatctacccaaatccaaaggctttaagatgctgaagtacatcacaaggagtacctgcttgcagcgaataccaatagtcatgatgtctgcccaagacgaggtagctgttgttatgaagtgtttgaaactgggagcagcagattaccttgtgaagccactccgtatcaatgagcttctcaacttgtggatgcacatgtggagaagaaggcgcatgctgggactagcagacaaaaatattataagtaagaacttggggcatgatttggatatgcttgtttccgatctcagcgactccaataccaacagtaccaatttgttctcggatgatactaatgacaagaaagtcaggagccacgctggtccagaaatcagcacgcaagtcactccttctgagtgcgagttgcagtcgcacgattctcctaaattagagctttctttaaagcgttcatcggaaggctcccctgaagaacctgaaccgggttccttggcaggaaaatttctctcgtacccaaaaaggagtgagctcaagtttggaggtgcatcagctttcctcacatatgttaatgcaagtgttcaagcaaacaggacgccaaatcaaatcagtgtaggtgaaaataaagcttcccagcaagagacagctattccagaaaagcatggtgtgatgggtccaccatccacagataatcgccccatcgggctatctcacagttcggaagctgtgaaatcttctaatcgtactgagttcattccttgtgaggaacactgcagggatagattagaaactaggtcatgtaatgtttctatgtcgcctgaaattcccattggacaggtggcacctgcaggtgagcagttccccatggttcagggaggtcttcctaatgaaggttccggtatgaataatcatgatatttcttcactaccggctcctcactttttaccgggcatgatgaatcattcaatgtcagcttcaatgcaattttgtcatggagtgcaccacgatgttggaccgcgtggtgctccaagattgataccatttcatacattccagccatgtcatggtatgcctgtaaatgccaccatgccatattacccatatggcttcgttgtagctcccgcaacgattggatcgtcacatgcttggcctggaatggcaaatttgtctgtgtcagaacctaagattactcaagtggaaagaagagaagcagctttgaataaattcagacaaaaaagaaaagaccgttgctttgataagaaaatacgttatgtaagtcgaaagcgcctagcggagcagaggcctcggattagaggtcaatttgtgaggcaaactaatgatatggaagcagctggtgctaatggggttgtttatggtgtcgattcctctgaatatgaggatgatggttatgtacatggttctggggaattaagactgacgtcttcccctgaaagcctggctggagacacagagaatgctatctaaaattaaagacagaactttagaattcaactattgttctaatgagcatgttgacatggtccttcttctcccattctgaagttctccctctttttggaccaaaaaggctgattcggtggtaacaacttttgtgtttatcatatctggcatttcaatgtataggactcttggtattttatatctactcaaagtcttgatttcaaaaactttgtgtttttgaagtgctaatacagagaacgtgcatatagatgccttttgcaagagattgaaggttcacaaactatttattgcctccaaatccgaatattcagccattttgtggctgaaatatcatggctaatttagtttatcgtatcatgcctgttcaaatgctgcttgtaattttgttgtacgtttaagcagcaattattcatttgttattgatttcctgggaaagaatgaagaagttcctcattgtacaagacattctatctctgtgaacacattcaaatgaaactaaatgcctcagagaggatacttgataaaaaaaaaa

SEQ ID NO: 1899 - DNA, 2119 bp, Pinus radiata
gttgacaggtgctttgcagtgaaaggttccaggttggcaggtactctgctggcagagaaatctgggcatgctgtttgagttttataggaaaagctattgacattgaagcctggcagctgaacaggattacttgcaagttgttattcatttgttggaatgatgagtagtcagaagggggaaagtttatggcacaaagatccagccatagagcctcatcatgccatccaagctatttctaccactattgcctttcaaacttctaataccagtaaatccgagggtcccacctttcctaaggataactcatcttttcaacgtctcgtgccacagtcagtatcatccaattcccctgaaccagtggattctaaccaagaaaatccctttcctcgatcttcattaccatcttcaagtaagaagctgaactccagtcctatgtcctcaaacattatccctgcctcgtcaaatgttattgatcccgagcacatttcttctacatcctcgacattttgtactgatctacatttttcaccctcgatttcacaacatcatccacctggcatcctgccattcctcccccatccatcagaaagttcactgcgggcttctgtcatgccgccctctcaatctgcattttctcagtctctattttctggtgattacatgaaacagagctatggagatacacattcaggggatcccttgcaggacattttcaacttccctgatgttgcttcagaatgcagccagcgtaatcaggttgctgccagtagtggaatagttggccaagatcatactaaaccagatgaatggcaagattggccagagcaactgccttctgatgatgactctttggttgccagttggactaacctccttgttgttgatagtggtgaagagcctggcttgaatacaatatatccggctgcaacgttgccaagtacaggttctgtttcacaactccagcaggatctttgtgcccctgctggaggaaatcaagttgcttcaagctccacatcatctggaactgggacttctaacaagccacggttgagatggactccagaactccatgagagatttatcgaagctgttaagaagctacatggtgctgagaaagcaactccaaaaggtgttttgaagctcatgaatgttgaaggcttgacaatatatcatgtgaaaagccacctgcagaaatatcggattgctaagtatatgccagatcaaagagaaggcaaaacttcttgcagtgctgctggaaaagaagacaataagaggaattcttctgatgacttatcaactctggacctgaaagcgggaatgcaaattacggaggcattgcggttacagatggagatgcaaaagaagttacacgagcagcttgaggtccagagggcattgcagttaaagatagaagaacatggaaaatacctacagaagatgtttgaagagcaacaaaaaaacagatagctcattcaagagtcaaagcctatctgcccctcgttcaagtaatccgtttgctgctgcagctccctttgagcagtcttctgatgttgaagattatggttctcgatcatttcctgccaaaagaattgagacggggcaaagcggggataagagtgtccatgggacacttccagctgtgagtgccagtgacaaatcattgccgattgtggtggtcgctgacaacaactctgaagttgtggcaaacaccgaaaagaccccccgtcgttgtgggtcagggtcaattccagaggccgaagatggaacaaattcaccaccggcaaaacgtatgagatcaaaccccgagaacacatgtatggataaactaggtcctctatcaagaggcttggtatcatgaacaattagcctttgcctgaatcagtttttgagacatgcatttcaactttgtctcagcagagggatatttttatgtggtgctgaccaccttcggcagtctttagtgaacaaatattccagcactctggatatgggctccgcgaggatgcatgtggattgtaagtagaaaagagagcagtgcaggtcactaaattcacaatattatgcgttttggagcacctttcgtgtgaaacatatgcttatcatctgttcaaaaaaaaaa

SEQ ID NO: 1900 - DNA, 2077 bp, Pinus radiata
agaataaagacgatcgcttgcagctttgagagaggaattctcaaaagcaacagacaaagcctaaagccaacgcagagtctgtgattccaaaattccaattccaatccccaagaaatggccaacacgccactaacagttacagtcggacagagacctctgcctctttcgcgtcaccagcaacctaaacgagaagaaaaaggaacgcaaatctttccgacaatcataaagaaaatgtccagattccttttccacctcaattgcatggcaatgatgatggtgtatatttctctttgcattttccatgagttctttacaactcccccttatttttcttttcctgcttctggatcatccagtcggcttctttaacccttcgggtggaccctgctgttattactttttcgctgaaaagaataattcgaagccaagatcgaatagatgaaattgcaggcgacgtgtggcggggaatcaatcaaagcaaagcgaacgcatttcggggaatggctttactgcacgggattcgatggcgggacaagacatagaagaaacaggcagtctccaggcgctggaaatggaaaagatttgagcgattcggaggtgaagggattcgaacatgtaccaacagcagcacgcgaacaagaaaaacaacatgagcatgcaggtttcttccggagatgctgccctggttctaaccactgaccccaagcccaggctccgatggactgtcgaactgcatgaccgctttgtcgatgctgtcaatcagcttggtggccccgacaaggcgacgccgaagacgattatgaaagtaatgggtgtcaaggggcttactctctaccacctcaagagtcatcttcagaagttcaggcttggaaaacaacctcacaaggagttgaacgaccacaaggacggggaaagagggtctcggtttagtgaggggcatggggcaagcacttcatcctcgagaatgatgggccaggaaatgaatgagggtttccacatatctgaggcgctaagaatgcaaatggaagttcagagaagactgcatgagcatctcgaggttcagaggcatctgcagatccgaatagaagcacaaggtaaatacatgcaatctatactagaaaatgcctgccagacccttgcatgtcaaactggaccctctgcaggcacagaaaccagacggcaagagcttccagacttggcgtctaaggtgtcaaatgatttctttaggactccccctcggagtactgtcaattacccttctttgacagaaatgaatgcttttcgtggtgagcacaatcatattaggcagcagactcagttaacagactgctctgtggatagctgcttgacatcaaatgagacttttgggaagatgattgaagagaatgtgcaaggtgtgagtaagaaaaggccaatgtccttctattgtgataacgatacatcaatatgggaaaaagatggcaaaggggacgatgtgcgagtgcatgaacttagcaacgaacttagtaacgcttgcttgggacagaaagaaactttcaagggggagcagaggccatcctcttcttcggtaaaaattgagtctgagaggaactctgccagtgatgtatttgaaacaagaggtagtcaattacaagaacctgcaagcagcagcaaaacagataaagatcttcggaattcccctaaacttgaaaggcctgctcctaagaaaaaccccaattgttgcagatagaatgtccccacagacaaaagatggtggcttctctccaagtacaaatttcttaatgggggaacaagtaaatctgtgatgttttactccagagagtcatttaagtgttactgaaagtcaaacacaatctgtagtgctgaagtatgagtcatataattagacttaaacagctttatactgtcctgacaactttgtacgtaagtcaataatctatccaaaatatattgagattgtttcagactctgaagttgtaacgttaactcctcttttctttcttgtctgagagcattggatatcatgcaaataacaacgatatgcaattgcagaaaggcggttgtttcaaaaaaaaaa

SEQ ID NO: 1901 - DNA, 2612 bp, Pinus radiata
ggcactttacatttcatttgattgattcgttggatttaactggagcggattttgtatgcacttgagaccagttttatggggtgtcaggtggccacgacagaccactagattgcctttgcctgtctgtgctcatcatctgcctgagagggaatgaaaaatatttgtatgtttatgaggagccatctggtttaatttaatgtttaagcatggtaagtgttgcagagtggaaggattttcctaaaggcctcagggttctggtgttggatgaggactctgaggcagctgctgaaattaagtcgagactggaaggctttgaatacgttgtttccaccttctccaacgaaacagaggcattggcggtgcttgcaaatgagacgaattcattccatgttgctttggttgaggtgagcacaggtaacagctgtggcggttttaggttcctacaaactgcctgcaatataccaaccgttatgatgtcaaacaggagctgcctgagcacaacgatgaagtgcatagcactgggagcatcagagttcctacagaaaccaatatctgaggacaagctcaaaaatatttggcaacatgtggttcacaaggcattcagtgagagtggcactgtgctttcaaagtctcttaaaccagttaaagcaactattgtatccatgcttcaactggggcacgagcatgataatgttaagagtaaaagctctcaaaatggagattcatctgttggaaacaaagctgaggccgatgctctacataaggtacagtcttgcatgccaactcgcacagattctataaaacaagagtcaagcattgaaccctgtaatagtgagaaatttccagctccatctactcctcaactagaacaagggggtagatctccctgtgaggaggataaaacacttagattagacgataccacaaacttaatggttggaccagcgcatcctgacactaattgtggggatgaaactataagagaagtgagattagatgctgaagcaacatcaacctggtcatctcaagttgatagcccagcatctgtaaagaaagaaagtcaagacatgtctagaatatcactgaaagcaagaattagtacccaatctggagtgaaacctgctgatttaacaagggaccagttggggaatggaattacttctaggggtacctgtttacactccgggcaggagactgcagatgtgcatgtagttagtgcttctggtattacagaagaggaagtgggttctgctgaaggttcaaagagtgatgatgagaatattgagacagaagctatattgtcttcttatgtttgtattgaagagaatgtagattccagtacggaaaatatcaaggaaaaaaggaacagcgcagagcatggttgcaaaaagtcgaatatttcttctagcaagaaaaagtttaaggtagaatggacaatggacctgcatcgacgttttgtgcaagcagtggagcaacttggagttgatcaggcaatcccttcaagaattttggaccttatgaaagtggatggcttaactcggcataatgttgctagccacttacagaaatatcgttctcacagaaggcacattttgccaagggatgatgaacttgcaagcaggcgatattggcagcattttgaccctgcctggactagaactaagcaagatgaatcttggagtcgtacagggaatcctgcttctggaccaattcttgcatattcaccagttcagttacattctacaccacatgggactcctgtgggcccacctcttcatgtttggggacatcccactatagatcagtcaggtagtcacatgtggcagcaacttcaagtggggactcctactacatggcaagcacaagatggttctttctggaaacatccaggggtatatgctgatgcttggggttgccccacagttgggatgccattctacccgcaacccatgatgaagctaccttcaaatcatggtcacagatcaaccccaaagccaaattcaacaatgcagggtgtttcagtccaatatcctgcaactcttgatccacttaatgaatctcttttatgggaaaaatccattaacgagcacccgccaaaggaggtaattgatgaagcttttaaagaggctttaaataacccttggacacctcttcctctgggccttaaacctccatcaatggagagtgttatggcagagctccagaggcaaggcattaataaaattccaccccctgcttcataagctgtcattagcatgcagatggaaagtcaaacagtttggaatgaaatgggaatttaaccaacaacaagtctcccctgtcagatcagaattgatcctttgctgcgtgcttgtacatttctgcattccaatgctacagaatttccccttgcctctctgcaaaaagtgctaatttttgctgagagattatacgcaccttacatggtccaaccttttatcaaggcagtcattgaggaatgcatcaagtgaaggaaaaacaagctctgcaaaggaaacatttgtaagatctcggcctaagcactccctgcaagatcatgttagaggcctctgaagccactggttgagagtatcatgttaggctatagaggtgtt

SEQ ID NO: 1902 - DNA, 2493 bp, Pinus radiata
ctcctccttcctgttgcaaagctacaatgtcaaccatatcttacaattcccatgctccttcctttcaattctaccagaatccttcctctgactggcttctccacaataaggccatggacatacagtcccaccaccagcaccagcagttcctcttctgggaacccactccccttttgcctgctaatcacaagctaaacccatttacagcatttcccccaacatcgcttgaaagcatagagctatcaaagtctgatgccgactatacatctctgtgggactctggacaaattgaccagaaacagcacattagtgctctaattttaagggccagtgagcgggattaccttgaaaataaagtggatttttgtgataatgtgtctgtgtccactgtaacagatgagaaatatgttcttgatggtttgtatcagggctttgatgaagaaggaggaattgtgcccagcaaggcctttggggagctgccatttcctttctttgatgatgggattgatgtaatctccttccttggcaataaccaaaatccctgcagcccttctgatcattcggaagctgttgggtccattgggtcctgcagctccgccagtttgaattctattgacaaatttggtaatgaatttgttctcagagatgaatacccatctgaattcgaagccgttttaggcctgcaagtgcccctattaggccagcaggacctcctccaaatccttgtgaaatgtgcagaggccttatcagagggacaccatggcctggtgagatcaatggtttcgaaactccaggagttctcatctccattgggggatcccctgcagcggatatccttttatgtaagcgaggttctcaagaaccacagttttagtgtagttaaccaggaagaaaatgacgaggaatcaagcctagagtatgatttggcctaccaggccttctatcagcttcttccttatcacaaattcttgcacttcacaagcaaccaggcaatacaagaagcggtggacaatgcttctaatattcatatcattgacctcgagatcagacaaggccttcagtggcccagcttcatacaatcgctagcccacaggcctggaggacctccgaagctgctcaagatcacagcgataggacaagacgagaagaggctcaaacagacaggtaggcgtttgcttgagtttgcagaatcaatggagattgcatttgcttttcacccggttgttgtggacttggagaacctggatgaatcggccctcaatatagaagcccacgagactatagctgtaaattgctctgtagttcttcacagactgctatgcaaatcgggtaagattcatgggctactggcattgctgagaaagttaaatcctgccgtcctaacagtaatggaaattgaatgcaatcagagcatgccttctactgtgggccgattcctgcagtgtctaattttccatagggctgtctttaactccattgaggccatcgtagagaagaataaccctgatagggtcctgattgaaagagtttatgttgcacccaatatctctaatgttcttgtccatgacaaagagaattcaggcatgtatgcctgtattgatagttggcggaaatttcttcgccattcaggctttaaggattctcctctgagcaactacagcaaatgccaggccaatctcttgttgggtatgtatccaaatgactccttcaagctccaccaagatggggtttccattactcttgcttggcaggatactcctatcgtttctgtctctgtgtggacctgttagttcaagtaacctctgtatttcctttgcgaagatcatggtactactctctttaactagttgtcacgcttaagtacttgaggcgtgtttctaaatctgtgtcctcgtcatctgtaaatccattgtccaacaattaggtcctcttgcccagattcttttgatcttgaatcgagctccttcctcagtatgttcaggagcactagatatcatttttggcgctggaccggtagaggaattggaaggaaacactgcaaaaaagcagattggtaaattcattgttccagcttcccgtgcacattaataggtatgccaaaactagtttagaatgatatatttctgtatggtgagaatggccaattgtataccagaaaagaaggtagctcatggttcctcgtcagcaaacctctgttctctgcagctgtacatggcctttcctccaaaagctgattggaattatacaaattattgatgtcaagcctcacaagcaaggctgtaaataattgttttcatatgtagcttctttactccacaaatgaaatgtctaaacatcatttacacaacagggctttacaggttcttcacttggatgggtaggtaaggggggtatttagatacaatgataacttagtaatgatcatgtactcttttgaagggatggcaatatcatccttatcattattaaaaaaaattgatcttaaaaaaaaaa

SEQ ID NO: 1903 - DNA, 3060 bp, Pinus radiata
aggcggtagtgtggaggaggatttgggtctctttcctctgagttggagccgttggccgagtcctttccaggaggtgaaaacaaaaaaaacagtatagtcaatgccctccactgccaataaatacattctggaagctggaactgccctcggcctccaatgctgctgctcttcatctgattattattattattattatcatcagcagccctctttgtcatgcctgcaataatggattgtcatgcagggaagagtgctctggcccgtgcaaatccaggatcttcaggatttccttttacaaatgtaaaagtttgtggtgccaagtatcagtgccccaattgcatggtcaagaatgtaggagttcagtctccttgtgaatgctgagactggtcaatataagtaatttgaagatagaaagatttttggcacctggcgggtggagatcatgtctatcctaaggcccttagaatcttctgggagctcaagcagtgaaggctgccttaatgttggcagaaacaacagagttggaacacctccattgataaacccatcaaatgtgatgaaactacactgcagaccagaacttaatggtgtgacatcaaatcctcgagctcaacttggcccgtttacatctgaaattcatagccagctactgtccaagcgttcactgtctgatttcgaaatgcaggctctatttaggacagtgagacaaaggaaccacagtacaccaatattacctttgtcgtctgctgattctgttgtattatctcactcttcagcttctctttctcagagtgtgagctcatatccctaccatagacaccagctgaacattagtccttatagccaaggctatatctgtaaccctgcatcattgtcaactgtctcggactctaatgtggacaagcttcttagtttgccagctttacagaatgcttctgctcttgagaagcctgcatccaaccagaattttgcaaataatcgtactttcattctaccaaaattgaaatcaccagatgctcacagagtggccatagataatgctaaaatggatgattaccaagaaggcattcggcacaagctgcaggagttggagagggagctactcagtgataatgatgatgctttcattgtgagtgcccttagccctgagcaaagcagtcaccttgatcgtgagtgggttgataccatacagaatcttctatcagaagaagctgttcttctttcaaccatttcaggtgaatcgcagggttaccataacagtaacaaggaaaatccaacaagtcaagctagtagatctcagccagaagaccaaaagcattcattttcatcacaaccagagccaaaaacatcagcaacacagcctcgtattgatgcagcaagctcttctagaaagctattggtggagtgtgcaactgccatatctgaaggagataaagacagtgcattgtccataatcaagaagctgatgcaagtgatctcagtttatggggatccaatgcaacgactcacagcatatatggttgaaggtcttgttgcacgcctaggcccatcagcccaaagtctgtacaatactttgaaatggaaagaaactcccataaagtctgatatattgtctgcaactcgattactatataaagtctgcccatatatcgagtttggatgtgtggcagctatcagtaccatccttgaagccttgaaggaagaggagaatgtgcatatcatagattttgaaattggagagggaagccaatatgtcaccttgatctacaaacttgcagcaagagttggtggacctccaaaattgcggataactgcggtggatgaccctgagccaatctcaagatctgttggggatttgtatatgttacaggaaaaactgaaagaaattgcagttcaagtgggtgtccatttagagttccatatcattcctcagaaggcagcagatgtgcaaccatatatgctgggctgcaggccaggtgaggcattggcagtcaattttgcattccagctgcatcacatgcctgatgagagtgtctctaccaggaaccccagggatcaacttttgagaatggtaaaaggcctgagtcctaaagttgtaacagttgtggaaagggaaatgaacactaatactgctcctttcctccctcggttcatggaggcactgaattactactcagctgtgtttgaatccttggatgttagcctcgaaagggaaaaccgagaccggttcaacattgagaagcagtgccttgcacgggacatagtgaacattgttgcatgtgaggatgcagaaaggattgagaggtatgaagtagcaggaaaatggagggccagaatgacaatggctggctttaccgtataccccattaacacaagtgttgacaatagtattcggcctctgttcgagtcccgtggcaataactacagactgaaggcagaaaagggggctctgcacctaggatggctagataaagttctggttgtggtatcggcttggcatttagaatcacattccatgataaaataacacaggcacagaccaacatgatgagattcaaacggtttaacacatccttcccatctcaagtatattatgcatttggtcaacttaggcccttaccttactatgtctgaacaatagaggtatgtactctttatctgttgtcagatgcaggtaatgaaagctgttcagaggacttgttgaacctaccctcaacaatagcacagcaaaatttgctatgccatctgccagtttgagttgctagtgcaacctgcactcatttcaggaagacatgaggcctatatttatagtcaactgatgatttactaacacataactatgtggaagatgcaaatgatgcagagagtcagataattatatatagaattagcttaatggatactttgtccttctgttatgacttcaaagatttgtattttatggtatgtggcagacactctgtcaattcacatgctcagaagcggacttcagaagatcttgtgtcagcctaaaggcccgatttaaattataattattggattgcattgctaaaaaaaaaa

SEQ ID NO: 1904 - DNA, 2992 bp, Pinus radiata
gcttggggctctgagaggtgctgagaatttgagagaacaagcctggaaatcgatgcaaaatttgagtttttgaagtgggtatctctgcttttgctctgatagacaaggaattggagagcatggaagttgcgggttcgagtcctggttgaggttagtaaagcagtcagcagagtttgtttgtgtaacagtttttgctgtgtgttgggattttttgttcgttttactgtcaatgaacgggatgctaagcaggacttcggggaattcgcttccgccggcacagttgaagcaccagattctgcagtcgaagacgtcgccggatcaagcacagaagcggcactgtaagtcttcggtgtggcagaggagcagaagtggtggtgagattgagccaacttcggttcttgatattcgaagccctagtccgacatcgacgctgtcgtcgtcgttagggggctcgagcgagagcgcgggggcagtggctgctgtttctagtggcttgttatgcgaagccgtttcggacggcggcggcggcggcagcggcagcggcagcggcggtgcggaaaccctgctcctcgagtcctctggcaaagaagcctttaataatggcggcggcagcaccggcagccctgcgcgctggtattctaacagaggcggcagcggcaacggtggcagagaaggattcgggtggagactgaacaatggtgagcagcagcccggtggtggcggaatggtcgaaggaaaaagcgaggtcaagaaagaagatccgcagcaacacagccgagcggaggaatggggttccggtggcggtgctggaacggcggggggaatggatgatttggagagcatgttatttgagtccggcgctgcgccaccggatcagtcgcttatgcggtggttgttgggtgagattgaagaccctaaagacctccctccgcctcagatcaaatccgccaccagcggcggatctacatctgcccctcagttcgtggatccttcaatcgagccaaacttcgcagacccgggagcctttgctttcagtaacaataatctcagcgatgtcatcgctccgccacagcacgcttctgtcccgtccagtttccgcccgtcttatgccacattgcctaacctgccccaacaacaatttattccgccgcctcctccacctccgcctcctccaccaccaccatttgcctacaatggccccatgcccacgcccttcggtcccaatgcctatcatccggaggttcttttctccgggccagcagtctacggttcgaatcccgtgcaacacttgggaccagattttccccgctttaacatggccgcggatccaaaccggaacaataataatcttttgttcgacatgccacacccgcctcctcccaaacgttttggacttgagcaccagctctggcagcagacattcaagcagcaggaatacatgagcatgatgaaaccccagcagcagcaagaactgctgcagtctcttcacaggcggcagcaattcctccaccaggcaccgcctccgtcgccgcaccaccagctgaggcagaaggccgttgtgaatcacactttcaaggtagggggttctggcgcagtggcggacgaggtgcatgtaatagtggagcaactgctcaaagcagcagaggctgtggaacttggcaacttagatcatgctcaggcgatattggcgcggctcaatcagcatctctcccctctcggaaagccccttcagcgggcggctttctatttcaaggaggctctcgcttctcgaatcctcaacaccaccgccaccaacactggcggagacaaccggaacgctactgtgactggcactgcaacttcaaatatctcttcaccgctggacatggtgcacaagataagcgcatacaagagtttctcggaggcctctccgctggctcaattcgcacattttactgccaaccaggcattcctggaagcgctggaaggtgcagaggcaatacatatcatagatttcgaaatcggcttggggggtcagtgggcatcgtttcttcaagaactcgctgtcaaactcggcggcgctccgcctgtccgcatcaccgcgctcggctcctcggcctcctcgtccctggagctccatcttacgagggacaatctatgcaatttcgccaagcagctcaatgttcccttcgaattcgagctcctccatttcgaccacatcgagtccctgacgctccgcgagcgggaggccgtggcggttaatctttcattgttgccttctactttcagttcgccggactcgatctcgcgacttctccgcctcgtgaagaacctcgcgcctagggccgtggtggtggtggacgccgaaaccaccgccaccgctgccgcagcctccgccgcaactacctcctctgcctctttcgttcaccatttccttgaagcgctgcaattttactctttcctgttcgattcactggatgccgtgaacatcaacatggaggccgtgcacaagatcgagaagttcctgctagctccgaagatcgacgccaccatttcctccgccgccgctccgccatggaagaccctgttcgccgccgccggcttctccccagtggccttcagcaacttcaccgagacgcaggcagagtacctgatccagcgcctccatagccgcgggttcgaagtcgagaaagcgcacgcggctctcctcctcgggtggcagggccgcccactggtctccgccactgcctggaggtgcgggcccccgccttaattaattaaattatcaaaaaccaatttagcagactaaataacagaaataaaacaaaatctctgtttttccttttttcttgttaattttcccgggtattttctgttaaacctgagctttgaaaaacattactaagtatttttccctcaactctctatgtatctgctgctgttactgctatactctttatttagtaatgtgattagaagctcgtctgcttcttcgcttcttgtaaaaaaaaaa

SEQ ID NO: 1905 - DNA, 1845 bp, Pinus radiata
agtccccagaggccaacaacaactcccagattccttgtttaatgggagagccttgtttaatggggaatgaatatcccttgcagggaatcaaagctgaggaggccgtccttcaacagacacactttaacgaggccactgattcccagctctctgaatttttctgtggcaattcagatattggcccgtatagcttctttggcgacaatgctgggcacactatttctccctttgcgttgaaccctacttccactgctctgtttccgccgagtaatgcgctaatcacaccgaatatccatggtccaaaccctcctcccctctcgttcaccccggatttcaaaactttcaaggttcctctggatgaaaagcatccagagttgcagcttccatatggtcccaacccaagttatcctgagaaaaatgttgtttttcctatgcctgcagcccctcgaggtcatgtgggtgttgctcacgagggttttccagagtttgaaaaatcattgtactggcagcagatacagcagcgagagtttcaacctgcatggaaaacaatgattaatagaagtgtcagggatccattattttccgcagtgaagcaagaatggcctgggcggactcaccaaggcagggtagacttggatgaagttcagaaatcagcgatacttcaacagcttcttaacgctacaaactatgttgaactaggcagcttagacattgtacaggcgatattggcgcggctcaatcagtatgtttcaccccgtgggaaggccctccagagggccacatattacttcaaagaggcacttggtggccttcgatcactgcaacaaactaactcaaagtcatacctttctcctctccaactggttcacaagattaatgcatgtaagaacttctctgaaatctctcctatcccttacttcgcaaattttactgccaatcaagttcttctggaggctttggaagccgtggacaaaattcatattattgactttgatatgggccttggaggacaatgggcttctttcttacaagagattgcattaaggccaggagggcctccagcactcaggctgacagcagtaggatatgaatcaatggaaatgcatttgataagagagaatctgtgtacttttgcagaaaacttgaatatacctttcacatttcaggtggttgaaatcccacagaatgaagatttgaatcgttcaatgttaaacctgaaagaaggagaaaccatagcagtgaactattctcttggaatgcaaggattactctcgaaggactcaatagcttctattttgcacctgattaatcgactccgccctaagatagttgtggtagtcgaccatgagaatgagcaagctggaagctcatttgcacagaagttcatggaggctcttcagttttatgcccttctatttgaatcccttgaggctgtccacatgaatatggagacaattgagatgatagaaaagtttgtcatggcacctagaatttgtaatgtggtagaagcggcctatagaaggcatagggaaggagaaaatctccctaattggagaagtatgttccaggcttcaggtttcactccaatgatgatgagcaacttcacacacaagcaggcggaatcccttagtaggagtaggcagcaacgctttgggttttgttttgaagcagtgaagaagcagcaggaacaaattctgctcctcggttggcagcgacaaattcttgtctcagtctctgcttggattgttaataatgttgtttaatcatgtattaactatgtaagttttcagagtcgttgactcatgctacggcttctaacattgttgatctaatctaaaaaaaaaa

SEQ ID NO: 1906 - DNA, 2546 bp, Pinus radiata
gggtcatatttcgctctccatatagagttacaggctgcatattctaagcatttggttcacccaatttcatatctgaagacaggattcacttttctgattctttcctggagcgcttgggaatgacgttttctgcttttgttttctagagtctatctgattggaagggaacacatcatcaggggaaagcatatttgtgcctacattgacattaccttgacaaaaaatagaaacatgaaaatgtagaaaagtggagacataatcaagtgataatcagtggatcagttgagaagtatttgtttggcaactctggaaatattagtcgatcacaagcctatcacctgtacctttggaaaaaatttcatagctccaacgtaatctccagatatgaatgtccagtttgagacagagccgactgcaactactcagagttcccaatacgttttagaccatccacataaagcttttggcacttgcttaccggatccaggtccaagtgtagctagcaacatctctcttgaacaatcttccgggtctcatgagtggatccatggcactccaaaaactagttaccaaaattttccttgttctccacaagaggttatatcttatggcttgggccactgtacccaagctcatgaatgttatacaagtgataaatatcgtatgagtgatggttcagtccaaagttccccattgcatgataatgattctctacaaagtcaaagatcaactcatgaagctctgccatattctacgggacactcattttacagttctccatcagttcaaagttgttcatctaatggaagcccagcatcaccacaagtatcacaaaattacccgtctggtcgacattatctccattcaccacaggaaccatatggcccagctggaagtggctacagtggcactgagcaagaagaagatctgaaatacatgttgcaggaactagagacagcattactggtgtctgaaagtgacgatcctgacattggatccatctgtgaggaacagggatttccagaatactcagaatggaatattgagaacatgcacgacacaactgataattattgccaaagctccttatctgtttaccccaaaccagagcaggtagaagtttcctcaatgacactgaaccatgtaaaagtagaaatagtgaatgaggtagatatggggacaatttgttcttctaccataaattcctcagaagaacaaaagcaagaactggagtttgatatcccatacggtgatgtaaaagaactgctaattgcatgtgcaaaagctgttgctgattctgacaatgactcaatcaagataggtaaattgattgcagaaatacgacaagtagtgtcaatatctggtgacccaatgcaaaggttgggtgcttatatggtagaaggccttgtagcaaggttggcttcctctggagcgataatttataaaactttgaggtgcaaagagccttcaagtccagaacttctttcatatatgcaagttctgtttgaagtttgtccttattttaaatttggctatatggctgcaaatggtgccattgcagaagcattcaaagatgaagatagagtgcacataattgattttcagattgctcaaggtagccagtgggttacattaattcaagctcttgcagcaaggccacgtggtccacctcatgtttccatcaccggcattgatgatcctgtgtcaaattatgctcgaggtggagggttagagttagttggcaaaaggttatcaaagcttgctgaaatttgcaatgttccttttgagtttcaccctgtgcctgtgatgggacccgatgttcaggttaatatgctgaagtatcaagctggggatgcattggcagtgaacttttcctttcagctccatcatatgcctgatgagagtgtaaatacaagcaaccatcgagatcggataatacgaatggcaaaaggattagccccaaaggtgttgacattagtggagcaagaatctaacaccaatactgcaccatttttctctaggtttatggaaactttaagttattacactgcgatctttgaatctctggatgtgactcttacaagagaaagcaaggaacgaatcagtgttgagcagcactgtttggcacgtgatattgtgaatatcattgcttgtgaaggagctgaaagagttgaaaggcatgaactaatgggtaagtggaagtccagattcactatggctggttttaagccttaccccttaagctcaattgttaactctaccatcaagtctctcttggagggatattgtgagaactatacgctgttagaaagggatgatactctttatctaggctggttaaataggcctttgattgcagctgctgcatttcagtaattgattatagaaccttgtttaactgcaaaaactaattttcgaagtgtagggtaaatttagtgccaacatgaatgcatagaaaacactatacagcagttcattgacagaactaccctgtattccacatagttacttaaccacagttattatagcttgatctaaaaaaaaaa

SEQ ID NO: 1907 - DNA, 1895 bp, Pinus radiata
gaaggaaataacagcaaagaagtgagttagtggaggaacagatggctacctgtgtagagaaaatgagcgacgagaacaagcccaccagaaagggagggaggaaggctgctgtgaagccaaaaactgttccagtgattgaaaacactgttgcttctccggcggggaagaagccgaaagaggaccagaaatttccttcttcttctcctgatattctaatggaagacgaagcacagaaggagaacagggtggtttcgactcccaagccggttgggagatcgaggaagaaaagtgctcttcagaacgtgtcaaaccttattcctccccctgtaactaattcattgcaggaggagttggaagcagtgcggatcagactccaaaagctgaatatggagaaggagaagactgacaagttgctagaggaacgcgatgccttgcttagggagaaggaggccgagttgcagctcaaagcgaaggctcaagagaagcttcagttggagctcaagaagctccagaaattgaagggattcaaccctgtcatgagccatcctttggggcagtcgctacgcatgagtgagcttgcaaaggaggaagagaagaagaaaaagaaaaaggatccaaacaggccaaagaaaccttctccggcatatattttatggtgccaagaacaatggaatcaggtgaaatcagaaaatccaaatgttgttttcaaggatatgggagccattttgggagcaaaatggaaagcattgagcgcagaagagaagaaaccatatgaagagaaatatgaggcggaaaaggaagcatacttgcaggttgtgggacaagagaagcgtgagactgaagcactaaagcttctccatgatgaacagaagcagaagacagcacttgaacttctggaacaatatctacaataccagaaggatgcagagggaaatgagaagagtaagaggaaagagaaagatccatcaaagccaaaacatcccgttactgctttctttgcattcaccaatgaacgccgtgccgccttactggcagagaatcacaatgttttgcagattgcaaaaattttgggggaggaatggaaaaacatgaccaaggaagagagagctccatatgaacagattgctgctgaggcaaaagaaaagtacatgggggaaatggagctgtacaagcagcagaaggctgaggaagcagcctctgcttccaaagaggaggaggaactgaggaaacttgaaagagaacaaggactgcaactgctcaggaaaaaggaaaaaacggagacactgaaaaagactatgaagataaagctcaaccaaaagaagcagctgaaagagaaaaactctgatcccaatcggccaaaaaagcccccaacatcattcttacttttcagcaaagaaactcggaagaagttagtgcaggaaagaccaggcatcaacaacacaaccattaatgccctcatttctctgaagtggaaggaactggacacagcagagaagcaaaaatgggcagatgaggctgcagttgccatgatgcaatacaagaaggaggtggaagaatataataaatcacatttgaaggagcagcaacagcaaacgcaacaacacatctccttcgaccgtgacgaaatgaaagtggatggaactcttcccgctccaattaccaactgataaatgaatgctcattcatttcaattcactgttttgtgaaagattcctgacggcttagatccacgcaataggcttaggcatgttcaaccgtattagttgaatgctttgtaatcgtcattgatggacgcctcaaactgatattcttggctataaatgcctgttctggctgcttttcctgtatttcctgaatatggctatacttttacagttaaataaaatacagcaagt

SEQ ID NO: 1908 - DNA, 1574 bp, Pinus radiata
tgtgtttgaaaataaggcttccttccttatttgtaaggcttgttctggaagttgagagagggcgcttcagagcttggactgtttggctgttgctgttctggaatcaattagggtttgactatttttgatagcagattgtatctcacgtttatacgactgggttgcttgactttcatcatccctgacgtctgcgagacgataaatattgggcagcactctgtgtgaggggagaagattattcatggaggaggcgaagaataagcagagaggtctggaacggctgaagactttggcaagcgatgatatgactgggctggctctaggtgtaggtctctccatggctatgcctgaaatagctcggcacggagacgatcagaaaagcgctccgctgcaactcgaacccctgacctttcgtcccattgcaacagcagcccgcgccgagactgctccggcgccctcggcgccgtttctttggttcatgtccaagaactgccgtgaagaggtaacggtcgcggagtcaaatctgtctgggatcgtacgcggcggagggatagacatgaatcgggttccggctaccaatgagtctgagtattcgtcggttttccaggccgatgccttgcggacgattgacactggttccgtggtagtgaagcgagagcgagaaagaacctttgagttggaggcggagagggatcgaacctgcgacgtgagttccaggacaagcgacgaggaggagataggttcgacgaggaaaaagcttcggctttccaaggagcagtctgcactcctggaggaaagtttcttggagcacagcactctgaacccgaaacagaagaacgctttggccaaggaattgaatttgcaacctcggcaggtggaagtctggtttcagaacagaagagcgcgaacaaagttgaagcagacagaagtagactgcgaggttctgaagcggtgctgcgagaatctaacggaggagaacagaaggctacagaaagagctccaagagcttagggctctgaaggcggttcctcctcagtgcgtgataggacaggataattactacatgcctctgcctgccaccacgctcaccatgtgtccctcctgtgaaagggtggctaccatggaaaacagccgtaacctttcattttccaagtcccggatttcgcagtttgcccaaaagtctgcagcttgctaactttgaggggcttcctcaggccaggcctgcctgcaaagcttacctgtgtaaaatataatttgtcagtggtagtttttggtcagattttgcgagatttggcttccctcgtaaagaggaaaaaaaaatacaggtatatatacactgcatatatcactgtataactcttgtggtttgcaaagcttgtccttgcagaagtcaatggcctattgtgctaattcactgcgtcagggaaatcatatgcccatgcacccatggtagtctctcttcaaacaagagcaccgggttgtaaacatgtgtaatatttctggttaaagataaaatcctggcttcaaaggaaaagtaactcgacacaagaaatcattttgcagtaaaaaaaaaa

SEQ ID NO: 1909 - DNA, 1998 bp, Pinus radiata
caaacggtttgataacatttttaaggaaggagaaaaaaattgagaaagtgaggccgagctaggtcgaagaagggtcgaagcaactaacagtatttgacatgaggtatctaggtagagggccgaggtgggtatatgtggagaggagctacgtgccaagtggagtttggaaggagcgcaaactcctccttcctaagtggattataggtttggactcttggaattgtgggcgcctggcatgccattccacattccatttcaatttcaattacccactggggacccactagcagctgctcctcctcttcctgctcctctctcgttcttctgtttttagccctccgccatttctgccaaccccacccacaatccatggccagcacaatccatgtgataggcctttgactgcccctctacggaattaaattttacagcatttcaagggtgtagtggtgctggtggtggggaatgcttggtttcgtttcacaatatctttcattcttcttctgggtttgcccttccatccatttcaggttttcgttgaatgagcgaggttttcgatttgggttccatggaggacaaaggattcgttgagcagaagcgaaggctgaaaaccccatctcaggtggaggccctggagaacatctatgcagagcacaaatatcccacggaatcgatgaaagctaagctctccagggagttgggattgtcggagaagcaggtccagcgctggtttcggcacaggaggcttaaggacaagaagggtaagaaggaggaacctgatagcaatgaggagcttgatgctggcagtgggagcaacctgcaacaacagcaacatcttgtcagaactgagatggggcgatcggagaagaagagattgttgggcatctctgattacccatctgcggtccttgccgccgaacttaacgatcacgacatgctgaagaggaatcagagggttatggaagaggaccctcatcatgcaggcactgtttccacttcccaagacacttcctcattgcagagtaagagttcatatgaaatggatgcgttgaggaatgggaactatgtggaaatgaaaggaagtaatagtaagaaaagcaaagggcaggttatgcatatgggtatggagcatacatatcctcctcaacactttgcagtggctaccgaagaccaatatattgccaagggcttgaaacaggctggtggaagcaattctaaacaggcaaaaaattggaatcgttttaaagctaaagacagtgagaaccacaggtttgtgaataatcatgattatccatctgctgtcctcgccgctgagctcactgatcgtgagctactcaaagggaatcatgatattgtcgaagacccttatgtttcgttatcccaagagcgatcgtccttgcagagtgggagttcttatgaaatggaagcaaggaggctgccatcaaagagtctgaattcatttgaaattgaagcaaggagcaagagaagagagaaagaaggtttacatatggtcgttgaaccaatatactggcaacaagctgtcgaacaccaggctatttctgctgtcaaagctcagctgggcagactatttcgagaagatggtcccattctaggtgtagagtttgatccccttccccctgatgcctttggctataggtagttcctctatattcctctccatgatctgagctaaactgtcttttcggtgatattcctggaaaagacattgatttaattggtaaaaggctatgtctgcctagcataagcatttgaaactctttgtatgccctatgctgcaattttgctccccattcttacttgtttacatgactatgtaagcaaggatgaggataaatatacttgttgcctctgcaggccttgtgcttacagtattgtctgaaagttattgtattacttatgtaggatcctttatttatcagagtgaggttgattttataaattctcaaacggtcagctcatttgcctggaaaaaaaaaa

SEQ ID NO: 1910 - DNA, 3413 bp, Pinus radiata
acatttctaaaaacccatatggtgtgagttctcatgtcagcaaggccgacttctgctgctgattggcagatatacacagcagatggggttgctgtggtgttgctggagtggacaataaagcctgtctttttcaggcttgaactgactgatttctttttggggttcctgggggtttcccgaggtatatatcagttaaggacattttgtcagttgctaagctgcacaggattttgatggaagggagtctattggttccgagggattccatgaatttaacagttcaatgcatttttcagtcgtcgtttgagagaacattctgagtcctaggttttaggttacgttcacaaaagccagccaaacagaccaatgaatcttcatctgcaaggggatattggagagatccagcaaatataggaggtgatgcaattgcgtaacactcccaccatgacttcagaaatgcatagttttattccatcaggtatagagttgctagccttttcttctaaaaatcctttcttggataattcagaggccgaggcatcaagcagatcatccgttatggggacatcataccaaggccttggaaatcctggtgccaatttggggaattggaaaagcttcaacgtgcctcaaaatcggtccaatactggctggacagctcccagtattgtggttccgaacaacatacagcagcatcatggtgggctatcctcatacagtggacaaattttgccaaacccaattgtagttgcaagaggagggtcgatgcaggctagctcgtctggagatataagaaaaagtgatatggatgttgcatcgcagaacccacatcaccaaagtgatggcacgcatctgttcctgatgaatccaaaatacccaaatgagtatcctgagggcacttctactgcagcagcaaatatgacagaaaatcgtcctactagtggattggcccctccagggtttgaagcacagaagaatattttggaatttgctcattttcctactcagattccaactatcatttcagaagctagcccatcgcttagagaacctagtcatggtgctggaagtgatctcccaggcagtgagaacatgcaacatagccagctaatgcttgctcagttcaacaatacagtgaattgggctaacagatatattggatctcaatcatggaatagggaaccatttattgatcagaacaaggtggatgaaagctttaggagtcatgaatatggctccaaaggacaagatggatcaggtcagagactttcactatcgttatcatcccaccaaccttctgaaatacatttgccggacatgggcaaccagacaaatgttttgcaatttggtggagatgctaaatccaagttaggcgatttttttaacagtgctcatggtacagatggtctggcctataatatttcctcatatccaaggaatgggattccaggaaaaggaactatggactccatacagggtggtggtcgctcagctgtattgcagtacctgaaggatgggtcaactggagcattatcaagttatggtattagtttgaaaaactccagatacttgaaggcagcccagcagattttatacgaattttgcaatgtgggcaggggtgttgaaaccaggactagtcccaagcagaaatcagccatgggggtcaatgctattcctggcagttcaggtaccagaagccatgagtttggtgcaaaaactgagacggggatgatgaatcagcccctctattcgggagacagatttgaactccagagacgcaaagcaaaacttgtatccatgctagatgaggttgacagaagatacagaaactactgcgaccaaatgcatctggtggtgagctcgttcgagtctgtatcaactgtgggggctgcagctccatacactgccttagcattgaaagccatgtcaagacacttcaggtgtttgaaagatgcaattacgggtcagcttcaggtcacgatcaaggcgttgggggagaaagggtcagttgttcctggtacaagcaggggagaaacaccaaggttgggatttctagaacgaagcatacgacaacagcgcgcatttcaccacttaggattgatggagcagcacccttggcgaccgcagagaggacttcctgaacgctctgtttctgttcttcgtgcatggttgtttgagcattttctgcacccgtatccaactgatgcagataagcatatattggctaagcaaactggccttacaagaagtcaggtatcaaattggtttataaatgccagggttagactatggaagcccatggtggaggagatgtacatggaagaactcaaggaagaaaaagtggaccaagttacacacaattctgaagctgaaagatccgctggaacaaacaatgatgaaaagaccatgtttaccagtggtgaaccaggcaacaaatgtactgccaattctgaagaagcagctttcaagcttgatcacagcagcagcacaacatcccagactgcccaagcagaaatcagctctggtaatgtgacattacacctgcaatcgaaggatccagagatggcagtggctcgggagactaattccgaacctctaaattcttccatgaatacttcccacgtgggtgacatcaaagtcgacgaagctcctgggtacaatatatttgaccaagacaagggattcagaaacgaattgtacgcaggaaaataccaaacagctgatcattctggaatggctgttgatttttcctcttacaataattctacagcaagcacttctgtggctgcatattcccatggggatttgaaccctagacattttcctagtagtggtgtgtctctcacattaggtctacgccacagcggaggcctttcatataatccattgagcgagcagaagtacgataataatatttatttctccagagttcacgatgatgctgatcccaacaaccagtacagtatgcttgacaatgaagtcagtccaggaaatgggttcatgcaggaacaggatctacaatacaggaactatattgtcaatggaagcaggctgttgcatgattttgtgggctagtcaaccaaggattatgatcataaggtgagatttgttcagattcatgatggagacattggtcaaattttccgtagctatttcctctatccagagccaaatttctgccctgaaaaataataattttaacttctccaattttccccatagcttttgtataaaccaggtgtagcattgtaatagaaaaaacattaacaagcaacgacgttggaggtgggaagattagtacagatatattgctgcatctgatttacagggagaaatcaacattcttattaaataattatatgtaatttgaaacaaaattatattatatatcttctctgtaaccaaaaaaaaaa

SEQ ID NO: 1911 - DNA, 3330 bp, Pinus radiata
aattcacgggtatgagagaaaaaaggaagtgattttgagtttgtgtttctgtttggcagcagacgaaaatggaggaagccagttaccacatgcctgcccttcctgcctgccctatctagttactctactctcctcacttaaccgtagcttattttagccctgacgttgttgctaggcctgcttcatgcattgacatccacagatagcagggatggacaaccagcaatgggcctgagtctgtcttcttctactaacattctgacacttttttatctgtgtgaggggaggtggaggtataaatctctggtcttctattttcctcctttgccttcattggtttgtaatctgatctgagctccagctccctttgtgattgggatttcttcatgggcataaggaagcggagggagattcaggagtaatgagttttgggggcttcctagacagtggttccagtggaaagctgatatctgcttctgatcacaacatggcttctggtgcaatcgctcaatctcgtttggtttctcctggtgtcatgcctttgggtagaccaactaaaaatatttacacttctccgggcctctcgctagccttgacgagtggaatcgaaggccaaggcgaggttggagcaagtgttggtgagtgtgagcaaggaaaaagcaaagacgaggagtatgagagtagatccggcagtgacaatatggatggtggatctggagacgaccaagatgcagcagataatccccctcgcaagaaacgatatcacaggcacactcctcagcagattcaagaattggaggcgcttttcaaggagtgcccacatcctgacgagaagcaaaggttagacatcagcaaacgcctgaaccttgaaactcgacaagtgaaattctggttccagaaccgtcgtacccagatgaaaactcaacttgagagacatgagaattctatcctaaggcaggaaaacgaaaagcttcggtcagagaacttgtcaatcagagatgccatgagaaatcccatctgcacaaactgtggaggacctgctgttcttggcgagatgtcctttgaagagcagcaacttcgcattgagaatgcccgcttaaaagaagagctggatcgattgtgtgcactagcagggaagttctttggcagacccattccttcaatgccatctgttccccttatgcctaaatcatccctagaccttggagtcggtggcatgcccacttcgttgccctcggctagtgcagacttgatgcatggacctgctggtggtcgaacaggaaacataataggtattgagaggtcgatgctggctgagcttgctttggcatccatggaagagttgttcaagatggctcaagcagatgaaagcctttggattccgaacctggatgctggtaaagaaactcttagctatgaagaatacatgcgccaattcccttccacaattacgccaaagcctataggccttgccactgaggcgactagagaaactggcatggtgatcacaaacagcttgaatcttgttgaaacactcatggatgtggatcactggaaggaaatgttcccctgcatgatatccagggcagccacagtcgatgtaatatcgagcggaatgggcgggacaatgaacggtgcactgcaactgatgtatgcagaattgcaagtgttttcaccgttggttcctgctcgagaggtttactttcttcgattctgcaaacagcacgctgagggcgtatgggcagtggtggatgtatctgttgatggccttcgagataattcgcctgcaggatttatgaaatgcaggaggttgccttctggttgtttgattcaggacatgcccaacgggtattccaaggtgacatgggtagagcatgcggagtatgacgatcgtggagtgcacaggctttaccgttctctgttaaattccgggatggcttttggagcacagcgctggctggcaactttacaacgtcagtgtgagtgccttgctattctcatggcaacagcaaacgtttcagcaagagatcccacggccataccgactcccaatgggcgtcgcagcatgttgagacttgcgcaacgcatgacggacaatttctgtgctggagtgagtgcgtcgactgtacacacctggaataagctctctggtaacattgatgacgatgttcgtgttatgacaagaaagagcgttgatgaccctggagagccacctggtgtcgtgctgagcgcggccacatcagtgtggcttcctgtttctccgcaaagattatttgatttcttgagggatgagagactcagaagcgagtgggatatactgtcaaatggaggtccaatgcaagaaatggctcacattccgaaaggacaagatcctggcaactgtgtttctcttctaagagcaagcgccatgaattccaaccaaagcagcagcatgttgatcctgcaagagacttgcacagatgcatcggggtctcttgtagtttatgctccagtggacatcccagccatgcatgtggttatgagtgggggtgatccagcttatgttgccctcttaccctctggctttgccattcttccagacggaccagaatgcaggccgcttgcactaaaccctactggaaatggcgttggagtcaacagcccgcgtgtgggaggatcacttttaacagttgcattccagatattagtcaacagcttgccaacagccaaactcacagtagaatcagtggagacagtgaacaacctcatatcctgtaccgtgcagaaaatcaaagcagctctgcactgtgaagatgcttgacataaatctctccctcttaatcctcactgtctagttttttttgtgtccccataagcttttttgttttttgtttggtccatgccaatcaatgtttaatgtgcaaggaaaggggagctggcattggcactgggcagttatgaggggatctcaacaccaatgtgctcgcattgagctgggtgttgatttgtccctcacagtaacagccacagccacctcctcctgcctgctttcacctttatcctgggatggacagcaatgggattactgagatcacatgatatatgtaactgaaaaaaaattcatgaaggatgcgtagtggagtcaagaacgcaccacatatatccttgccaagtggtaaacaaaactgaaaccagccagacaaagcttctttccttggcaatgcaattatcaaacaaacatgatgtttgcacaagctttaccaccatgcaagggtactggttcgggtattgactccccgcaaaatcttaatcgtttgctactctcatctttcagttaaactcaatcatcca

SEQ ID NO: 1912 - DNA, 3532 bp, Pinus radiata
ggccaacgttggcgggcaggcaaggtcgtctgcatacatttccactatctcgactgagctcaactccaaggcattatcaagccgcctcatcatcaatcgatcgataacggtgacacacttccttcactaaaataacaaataattgagagggaattgattgcagatgaatattggacagttttgaagtaaatcccagttacaacctttcatatattaaaaatgggaagaaatagggcccagaaagctactaatggccataagatgaatacagagaaagttgagaactcaaatcaacaatctaatttggtgaatggagatgcctctctgacatcacaaactatgaggcagtcaaacaacaaaatctctggttcatcatcccaccatgtggccccggcaaagatgaattctcggaaatctgagatacaagaaagtgtgtcaaatgcaaaggaaaatgaacctacagtaaaccctgtaactggagacaatcatgttgagtcagataagcctgaattggaccaaaagactggcaggtgtgctaccaaagctggcaagagcacgtcaatggttgggaaaaagtacatattgaggtcattgtccagtagtgttcgtgttcttagatcaagagaaaataaaagcccaaaggatcttcctaaaattgaaggccattctacggaaattagtgcagagcaaagccaacgaaggcggaaaaagcacaagaagaaaacacatgttgtacaggatgagctctctagaaccagaaagcacataaaatatttattgcttcggattggttttcagcagaacatgattgatgcttattctaatgaaggatggaaagggcaaagccaagagaagattaggccagaaaaggagcttcagaaggctgcatccaagatactgcagtgtaagcttgcaattcgtgaagctttccatcgtcttgattctttgtgtttggaggggagtcttccagaatctgactttgattctgaggggcagatcaacagcgaggatattttctgcgcaaagtgtgggtcaaaagaattggtgcttgataatgatatcgtcctttgtgatggtgcttgtgatcgtggctttcatcagaaatgcctggaacctcctttggaaactgcaaatattcctcctgaaggcgagggttggctctgcccagagtgtgactgcaaagttgactgctttgatttagtcaatgatcactttggaacaaattttgaaattggggatagctgggagaaagtttttgctgaggcagttgtgagcgcagatggagatgagaacccctttgatttggaaggcatgccatctgatgattcagaagatgatgattatgaccctgaaagtccagagaagcctgatagtaaccagcaggaaaagggttcaagttctgaagaggatgacagcacaagtgatgcggaaaattcaaataaatcaagcagtgatgatgaaggttctgaaagtgatgacagctctgatgtttcctcagaagacagccaggagcatttccctgagtacttggcagattcaggaaaaagaaagtccaaaatgaccagaggcaagaagtgtttggaaagttctgaattacctgtaatatcagatctagacgagagtggtaatattacgtcctcagtttcagggagaaggcatcgtcaagatattgactacaagaagctccatgatgagatgtttggcctcactgcttctgatcaggatagtatgagtgaagatgatgaggagtggggaccaagaaagcggccaagaaaagggaagcaatttgatgtggaacaaaatgtttctactgtgtcaaaattaacgcagctcaataaagaatcagtgatgaagaaaaaagggaagggacccaatgtcgactcctcagaagatttcaaacaatcaaagtttaatttatgcagagaatatgatgctgagacagagaatgaagaacacaaaatttcaaagaaagcagaacatggagaaggtggtcctgtagaagatgttgctgcatcaggatttaaagcatccttgaaagaaaatcagcaggagcaacttgggagtgcaccagtttcagcaaagcaaaaagtattttctaggttacctactcctgcaattgagaaatttcgtgtagtttttggtgagaataactttccaccacggtctttgaaggagggtttagcaaaggaatttgacatctctttcaagcaggtagacaaatggtttgacaatgcacggcatttttctcgccatcaagatagaagcaagcaagttgataattctgatggttctaatgagtcttctattattaaagatgacaatattacttcggaaagagtcaaagtgccaggcagtgcagggaaagggattaaggataccaacattgtgctatctgccgaaagaggaaagagaaagggtgggaaaaagcatggtatcaaggacttgaaaggtccaaccagtactggtgataaagcaaaacggcaacgtcgaagaaactagctgcctgtgaaatttcagcatttttcctgtgccagctgcaagctgtatatcagacaacattggctattgaataagtggagatcaattgtttcgaattcaaatgttcttaccagttggttgaataagtaagcgtcaggcgttattgccaattatgtacaggttgcctgctccagttttcacatgagtacacattgttctctatcaattttcaaatatttaaatcctttcttctgtccagttgttttcttcatttggcaagattatcgtgtccaaattatctagaacctttctaaatgtagttctacctcaaatcgacgaacatcatcccagatttctttttcgtaaggcgccagatattgagagcattgcaaagaaaattcaactgtttttttggaatttctatgctgattatttttgacagatccaactggtagcatatttagtccggattttactgcaaacagcatgggaagttctgagcaaggaaacatgatctgtgaaatccgatctccctggtctggatggatattccgctctgaaagtactagaataataagatgtcatatctgatcttgtttgtctgggcttgtcaatatggtgggcgattccgaacaagtgttgcggttttccaagaccccgagtaagctgttaggatggtacaataaatgcacatccttcactactcacggcgcaaggaaaatgagctgctgcacgttatttacacattatttaggaattatattgctattactttcatgtgttttcatattttagtggcggtgctggcttggtatggtgtaattgtactatgtacgtattttgttatatgccaatgcccatatacatgtagccatacaactcagaaatgaactatttcttttcaaggttgctggtaatgactgctcagtattgttgatttatctcagcaatctcgtactcttgcaactttcattatgggacaagaagtataatttttttttgaagtccaatgccacaaacactgctattgcagccattataaagaaaaaaaaaa

SEQ ID NO: 1913 - DNA, 1773 bp, Pinus radiata
caagtatttttgtttgattcttgctttgtttatgctaaatatttgaagttgtttgctaaattccagaccgagcccgatctatgttggtttattgagcgcctctgctaattttgtgaggttggttaaggttcgaatttcgcgctctgttttggtttatgattttagggataaaacgctaacggcggttacgaagaggcgagagcgagagcgagagcatttttatgagaggtgtgccaatcgctgcaaattgtgcatgtaattaaacctgaagtctggtatgtaaaggaggaaagaagggcaagactgaaagttgcagagggtaggaattgtttgtagagaaatggagttgggtgatcatgacggtgacatgggggggatggcattgcccatgctctatggcggctctgctcccaacatgattcatgattcgtcgaagctgaagccgggcgagaatggcaccgccggtaccggcacccccacgccctctgacgagactcgaccgtcggaccatgagctactgcagcatgagcatcatcttcaccatcagcaaccgccgggtgctcatgtcaagaagagcgtgagatatcgcgagtgcttgaagaaccacgcggccagcataggtggccacgccatagacgggtgcggcgacttcatgcccagcggcgaggacgggtcgctggaagcactcaagtgcgcggcctgcaattgccatcgtaatttccacaggcgggaagtggaaggggagcccccctgctatttctgctacagtccccggggcaggaagcggccgggcgcgggtccaccgatggcccttctgggtcttcctccggcgcagcaacaacacccgctcaatgcggccccgttggcccttccgccgacaagcgcccatgttgttcccaggtcgatgctgcagggagccggcggcgacaacgatcaagacggaagcagcggcatgagctacatgaacgcttacggtaccgggggaatgatgcctatagtgatgaagaagcgtttcaggaccaagttcagcaacgagcagaaggaaaaaatgtgcgccttcgcggagaaagtggggtggaggatccagaagcaggacgatgctgcagtgcaccagttttgcatggatattggtgtcaagagacacgttcttaaggtctggatgcacaacaacaagtcgcatatgctggccgccaaggctcagagatcagaagaacaatgcacctcccaataatttcacttcgccttccttccctctgcttcccctttccattaattgaggtgactgctatagatcgccactcggctcaagtgcaaagacactatagttacctttttctttctcccttccctcgaatgtgatgcacaccaaggattctgatttgagctcagccttctttcatagtctactctaatccctagaattagattaatgtaacataatgggatcgcccatgatttcaaatatgtaatgtaattcaagtagttctgtgcagctgcagatcatccatagttttacatctagacttactgggatgcgctcgtgaggctgcaggttcttctgaattccagccagcctgcaatttgtatctccacctttactcgaaaatcaatggcagatctctcactttgacgaaatattggccataatgttgttaattgcagaatatggtattgcagaacgaatgacgttgtttggttaaaggattctctgatagcccaagttttataatggactcccatgatctgttttttttttgttcggtaaaaaaaaaa

SEQ ID NO: 1914 - DNA, 3239 bp, Pinus radiata
atacgactagctgactagttgcccataatgctgctttgtccgatgcagtcactgaagcaggaaatggtcggacataactgaacctcaatgttgaatgttgttatatctgggagtgcaatcatttgaagaattattttgggcctgtgggatttgggtggcatcaatttgcaggcagtagttttctgtaagagttttctgggacctctcagatttgggtgacctttatgtttcagtactagcatcggaaagaaaaaatgccgaaagcaggaaaaggctcttccggttcactccgaaagaagcaagcgttgtcaaatacagcatcagagctaaggcctaaagctgcaattcagaagactaacaatgccgggagtatttctggcaggatgagggaaaggaaaccacggttacatgtacagatgattgcctcaattctcacgaaaaaaaggacaggtgaagcatctgaatcgagaaatgattctgagctagaagacaaacaatatctgagcaatagttcaaaaacaaatgccaattttgtagcggggaagttagttaaaaagactttgaaaaaagccccaagattaaacttgattaagaatgacagtcagaaaaaacccagtaagagttctgcttcgaggtcttatgctgcacagaaacctgaacggccacaacagagaaaaattaggaggacaaagtggaagggtgattctaaaaatataacaaaggtgaaaactgtgagaactagtaatatagatggcttgaagaggaagcagcaaaggagaaagaagaaaaagaaggcgcagaatgttccacaggatgaagtatcacgtgcaaagagaaggatcaaatatcttttgctcaaaatgaaacttgagcagaatcttattgatgcatattcaggggagggctggaaaggccagagtcgggagaaaataaagccagagaaggagttacagagagctgaaaagcagattctgcaatgcaaacttggaattcgtgaagcagtgcatcagcttgatcttctaagttcggaaggatctatagcagatgccgttattgatccagaagggcgtgtatttcatgagcatatattttgtgcaaaatgcaaaatgacagatgctcttccggataatgacataatattgtgtgatggagcttgcaatcgtggcttccatcagaaatgtctggatccacctttggctactgaaaacattcctcctggagatcagggttggctctgtaaagtttgcgaatgtaagctagagagtttggaagcaataaatgctcatttgggcacccagtttacagttgataatagctgggagggaatttttgctgatgcagctagaattgcgaatggtgaaagtacagctactgggaatggggaagaatggccatcagatgattcagaagatgatgactatgatccagagaaacaagagattagagatgaaacgggctatgagaataatatgagtgattctggaaagtcaagtggatggtcagaatcatataatgaaactgacaatgaatcagatgcttccttaacagataatctaaatgaatacatctctaagggaaagaagaggagcagagacactgatgaaaaaaacggacaagaagctataatagatttagatactgatgagaatgatggctcagacatgccagtttcagggagaaggcagcgaagagatgttgattataaaaagttgcatgatgaaatgtttggaaaagatggaccttgtgaagatgaagtcagtgaagatgaagactggggacccaataggaggcgtagaagagcgaaacagccggatacaaataccactaaggattcttcaaatgaagagaaagagcatgttagaaaggaagcagatgagaaagtagcagagcattcacaaagtagcataaaggataagaaacatattgtcagactgccagctaatgcagttgagaagctgcgcaaagtctttgctgaaaatgagctaccgtcaaggtcttacaaggaaaatctgtcacagcaactgggccttacatttcgaaaggtccatatgtggttcaaaaatgcccgttatatgtctctgaagagccgaaaggaaatgcctagaaatgagaactgcaatgaaactaatctcatgggagaaggtgatatggggccaaagaaaaaaataccaaaagagaagaaagcagaatcaacatgtcttttatcttctgttagagcagaatataaatctagaaatacaaaaaggaagcataggagaaaaaacatcaaagcacccttatctatctcttccagaagtgagagaaaaagaactatgtgcagactgcctgccaatgcagttgagaggtttcgccaagtctttgctgagaatgagttgccttcaatgtcctgtaaaatggcattatcaaagcagttggatctaccttatcggcaggtgcatatgtggttcaaaaatgctcgttatatgtctttgaagaagaaaaagatgaaccgtttaaaagaatcagctcccgttatttcctcacataccagaagacttgaagtagaaagtagcaaacccaatccacaaatcaaagagccagatgatgctggcaattcatacttaacagagatggaaaaattgggtaatattgagttgaaacttgaaaatatgagaaagattttagaaacagtctgtcctaaaagaggtactgatttttccaatgataagaatcaagaaggaatcgccaaccttcttagtgaggagcttcttgtgtatgtaccagtggtggagttgagggagaagagcttacaggttgctcctgtcaggtgactctgcttaagatttatgaaagacacgccaataagatcacctgtgcttttccatagaaataccttaacacatctcctattcacctagccttctctctatcaggttatcactcttttcacaagattgttcgcaagagtgatgttctttagattaaacggcataaaaaatgccatcattcttttctgaaagatgtggtgcatgccattcttttacattttcagatggtttttccttttgaggatattttccttctggctttattttgcatcatgcattgtctgtctggaatttggagcacaatgctcaccatgcccttcagcaaaagccatttactggctccttgttaaggccatgcctcaagaaatatttattgtatgtaataatataaataaaagtaagcttgcttcttgactgaaagtaaaaaaaaaa

SEQ ID NO: 1915 - DNA, 3897 bp, Pinus radiata
ctgtgtcgggccccgtacgcctccgaaatggttgccctgcccatccctgtggtcgtttgtcgggtaagctttttaagcctgtggatgttattaaaacccgcctccctttaattacagcaaagcctgctttctgtgcttttctctgacagaagcctttccaaacgtcaatttattggtaataatgagcaggaggagttgagcaagttaagggagctaagactgtgttgcactcgtcactttcatggtgtagtttgtcgttccgagactaacaagtttaatacaggaaatacatgggggatcaagtcctttgatttggctgagggattgcggtgttctatgctcgtggcgttctttgttcattaccaatcttcagcccaattatgtgccactccagccttgcagcaactagaattacagggtcagagtgagggtgtcagcagacacacaggtggcaaatacttatctatcacataaacagcagaagcatgggctctggtaggtccaaagatgtctcagcaatcccctgccagtatggatcaactcccactacaaactcatgttgcacagcaaattcggcgggataaacttagaattcaagggttccagcacccatcatcgcccaaaagccacattagtagtgggcattcaaaacaggcaattcctgcctatgaggaatgctctgcaggatacttgcaaggatatccaggacatattgatcaagataatataaaaaatgtatttcctggccacaacattcacatgatatcttctaataactataaccttcctgctgcttctgactcaagggttttaccaccacaaaatactggccattttcatacacaatcgccacaacgaaatcctcttgttggaaccatacattctggacaatctctgacacctaatttcgatggacaggtgaatgcatcaaagtcaggaagctggggttctggaggccctcagtttgggatgatgaataataatgctttcctgaatttgccatcattaactgtcaatagtaatgcaatgacagcagatttgtttgctgcttcaagcatacagacaagttcgtttggatcaaacggcagagagggaagcatggctacatattttccaggttcaagtatccaagctgacaccatgcagacactttatctaaggaaccggggtattgtaggttatacagattcattggcgtctgggaacatggtacttgttaacaatacaacaggaagttcattagcaactcataatttttctggcaatgggcaacagcaacaacatttcgtaggaatcacagttccaactgcttctccttcccaacactcctctgttggggctatagaaaattcttctacagaacaacaaagtgccaattcaagtctactcacatcacgccttgaggcccatgcttatgattcttggcaagctggaggaaatgagctaacattcctgcagacaacagatgcagcatccagtaatcaatccctttgtggacaattgaacaattctgttagtctggggagtcttccagttgctgagagatctcaggttagaatgaggcccccatctatgtcctctattgaagaagaacaatcaggaattcttcctagtggattacgtttgcaattagatccaccaacaactgccactggacagagacaggggctttctctgtgtctttttccaaaacatgcatcaactgttcaattgccaccttttcaaaatcactccactgagttggatataaattgcccaggcattgcccaaacggcttcagaagacaactcatttagaattgacagggatgctagagatgggatgatgggaggtgggttttcaaattctcttcagagtcctggagttagcaaacaaatacattccagttacagaggagtaactgggttccctaatgttctgagaggctccaaatttctcaaagcagcacaggagttgcttgatgaagtcgtgaatcttagcaagttcggaaagtctgagccagccaaacaccataaatcacaaacattatttggtactgctgctgacaaatggaatactgccaaagaaactagcataaagaatggtataacagatacaagtgcaggatttttaaattcagctgaagaaacaaatatctcccataatactgagatcagtatggcagaaagacgagagcttcaaataaagaaggcaaaacttgtggctatgcttgatgaggtggatcaaaaatacaaacaatactaccaacaaatgcaaattgtagtttcatcatttgaaactgtgactgggtttgggaccgcaaagacatacacttcccttgctcttggaactatctctaggcacttccgatgtttgagagatgcaattgtgggtcaaatttgtgcgtccagcaaaagtttgggtgaggaagatatggcaggaaatggtaaaggtgaaacatctcgcctccgatttgtagatcaacaactgaggcagcagcgggcttttcaacaactaggaatgattcaacaacctgcctggaggccacagagaggtttgccagagcgagcagtttctgtcctacgagcttggttatttgagcatttccttcatccgtatcccaaagatgctgacaaacatatgctagcaaggcaggcaggtttgacaagaagccaggtctcaaattggttcataaatgcacgtgtccgtctctggaagcccatggtagaagaaatatatatggaagaaatcaaggaagctgagttaggacattcatcagctgaaaaggactacaagaaaagtggtgacagcaaggcagatacaaagtcagaggaaggatctgaaaatagtcagaacagtgaagatcagaagcataccaagacaacgcaacttgaaactgatgcagaggatgttgtctgtgagcaacaaaacatatcagtaagcagtggtttgaagtcggagcattctcctgatatgagatatggcagaagtcaagcattcagcatagaaggggtatcaaatgatgacgtgtctcatgatgtacgggatgagggtgtgacaccagggaagtttaagaaggctaggagtggaattgaaggttctacatatcaattttctccaaatatgagttcaattgtaggtttcaaaatggagggaagctgccaaaacgacaaatttaatgatgaaagacacagtagtgagaattacattcttgttcacagtggcatggcacttgcagatagtggtggaagtggctgtttgaacagatacgatggacaagaggcatttacccccaagttttctggaagtggtggtgtatcactcactttgggacttcaacactctgatggtttatcattatctggaactcaacaaagatgtaattccagcgaaggaaggaatcacgggcttggaaatgtctctcatgattattgtaatattagtgggactgcagctgctcatgctgcaaacgcttatgagagcatcaacttagaaaagagaaagcgcttcgctactcatttattgcaaactttgtagcttaggtcaacggagatatgctgtatactatgtcctttgtgtgacttttctgtctagcatagcttttctgttaattcttttccatccctacagtggcatatccctataatggggctattttccacattgatactcttctgtgatcatgtatccttgaatgggtttggaccaatctatttgtcataaacctaatatttaaggatttcttgattttggtgttgtaattattacgaggctttttccttcaaatgcacttggaggaaagaagcataagccatttgtaaaattcgtattaaacagaaaaatcagatttcttaacactcattgtaagctcacttaatatgtgattcatattgacgtttctagaaactaaaaaaaaaa

SEQ ID NO: 1916 - DNA, 1307 bp, Pinus radiata
gaaattgatttattggctgccaataagctatgaccagagaattcaacgaattcctctgcttgcacggtagtcggtaagcatacccaatcttgaaggttgctacactgtcagggcttctctgaattaattccacggccagaaaccatggcgaacacggcggaacaaaaaaataaggaaacgactgtgcttgctgtggagggtcatagatccataccagctcccttcctcatcaagacttatcaattagtcgacgattcgagcacagacgacattatttcttggaataaagaggggaacactttcatagtgtggcgacctgccgaattcgcccgggatttgctaccgaattacttcaagcacaacaatttctccagcttcgtccggcagcttaatacatacggattccgcaagattgttccggaccgttgggagtttgctaatgattgtttccggaaaggagaaaagcagctgctctgcgaaattcatagaagaaaaagcgtccagcaatcttcagcagcccctgctagcagatgcgtttcgccggtcaattctgtggaagagcaggcattgtcttcgacctcctcccctgtttcttctcacgcagaggcggcgttagttaattgtggtcaaaatagcacatccgggctccatggtgaaaatgaaaaactcagaaaagataatttgcttctcatgtcagagctggcacaaatgaagaaacagtgcaacgatctcctcctgtttctgtcaaagtgtgtaaacattaccccggacaacctcagcaatatcctgatagccgcttctcaaacgaattgccgcgatgaaaacctgaaggcgttgccgctggacgcgtccacactggccaagttagccaataaaagtgttttctctgaaaatcacgagaaaaagaggccgcctaatcttttaacggagctttgtcgaagcaatgttaaagactcagacaccgctgtaaagagcaccggtggaagagaagcgaattcagacggtcacgaaaacgataacaaaacagcaactcccatgttgtttggagtgcctctgatcagtggcaagaagagacccatcccggaagcaccggcaagcagttcatgtgtgtccaaaggaccaccattgaaaggcataaaaactgatatgccgcacgaggaaaccccctggttgaaggtttgttcatcccgcgggggtaaagtctacaattaattgtgaatatccagtaaatgcattatgcaaatgtgctctgtaatgcaaccctaataatacttactatcatttacagtttctgttgaaaaaaaaaa

SEQ ID NO: 1917 - DNA, 886 bp, Pinus radiata
agagcaagaagctgccaaagccggtagagtcctgatggtaagcgatggagctgttagggatgcagggaggctagtgcctgccccttttctggtgaagatgtatcgtttagtggatgatccctccacaaaccacatcgtttcttggggagagaataacaacagcttcgtggtatggcgccccaaagagttctctgcgtctgtgctgccatgctatttcaaccacgccaatttctccagctttgttcgacagctcaataattatggatttcgaaagacatttcgcgggcagtgcgagttttcgaacaaattattcgagaagggcaagcagtatctcctttgtcatatccatagaagaagagcgtccaatagctcgcccatgccgatggaatatggtaaatcatctttattattcccaatcattctacctacacaacactccaatgttctggcagcgcctctgccttcttctctgtcaggccttgcagaaaaggaaacatttagaaaaaatgactcgtcgctgttatccgaaattccccgccttcacaatatatgcagcagggacatcaagttccttggccggaatccttccttgatcgacacggaccgatcaaaaatcgacaacgtcagtccgggtagttccatggcagatgttacagaggagatgcgtatgatcccgcaaaagttgtttggagtccttctctgctaggaaccttcctacagaagtaacaaacttttcgttatttgaaaggtcatgcgtcgagttctgtagcttccacctgaatgaaatgtatcggaatataaacacagaatatgtacgtgtacttttccgggactattttataataataagatcatgatcaccattgttttctcgtaaaaaaaaaaa

SEQ ID NO: 1918 - DNA, 1966 bp, Pinus radiata
tcggagaggaaatttttgaaggggacgcagagaggatgacgataaaggtgagcgggaagatacgccgagtcgacggaagggagatcagctacccagaattcagagataaatatatgaaggccaacgaaccagtcctcctcaccggcctcatggatgactggagggcttgccgcgattgggtttctcctgatggccaacccaatctctcattcttctccctaaatttcgccaaatcccgagttcaagttgcagattgtgacagaaaagaattcacggaccagaagagactggggatgactgttgctgaatacatcgaatactggcacaatctcaattccagattttatgacacggactgtgatgggaacaggaattactcatcagtgctttatttgaaggattggcattttgtaaaggaatatcctgattacaatgcttacactactccaacatttttcttagatgattggctcaacttataccttgattcttaccgcatccatggcattgaaggtgttgatgaagattgtgaatgtgacgtgtcgtgctcagattatcgctttgtatatatgggcccaaaaggtacttggactccattacatgcagatgtctttaggtcatatagctggtctgcaaatgtttgtggcaaaaaagtctggcattttctttcaccctcccagtcacatcttttgtatgacagatacatgaagcaaactgtctatgatatttatggagatgtctcagcaacacagttccctggattttctgagacatattggttggagtgtatccaagaaaggaatgaaattatcttcgtaccgagtggttggtttcatcaagtaaaaaatgtggaggacactatttcgataaaccacaactggttcaacgcttgcaatatttcatgggtgtggaacctccttgtaaaggactacaacgaaacacaagaatatattgaagacataagaagcatagctgatgactttgaaagcctctgtcaacgcaatttggcagctaatacagggatgaactttgatgacttttttgtctttatcagtcgaatggctcttgcaaattttacccagctcattgatatcatgcattcatgggaaagaagatacagcagaaatggcatggaagcttcacaaatagagaaatttcaacagattctctttaatttggtatccattcgtaatgttggacaaaatatggcatccattcattactttgatggctatagtaaagagtataaattttatataaaagatgtagccaggctctttgttgaaatgggaatgtcaaaggatattaataatcatgaccttgatgatgcccttgagaaaaaatgtcatgtatcacagattacaaatctaaaaatccccaatttcgacattgttgatgaagcagatatcaagacatctgtctctgtacttgaaggatcagagaagccaatttgtgataaaaattctagcaaggtacagataagattctgtaataatctttcatcttccatgccacaaaatgaaagaacagaggcagtgtgcggcaacttgttagttgatggcttcttaaccaaagattgtcaagtgactgttactaatcccaaacatctattccaaattattgatgatgtcattgcatcagtgaaagaaaaggctttgtgtttaggctatgatctgatacaaacctgagggggaaatgatgaaattataagagagtttctgtcaaatgtatagagttccaagtattttgcattataaggaaatggcagtctgaaaatattatttatagcattcttttgctcacaagtttcagagtaacctctcatatatccatgacatgttgacgcaatgagcaataagtgcttgattagatgtaaatgatgaggatatacatgccttctaaggacatgtctatgtcaaattcatgctgaaatatggcacatcttctttattctacaaaaaaaaaa

SEQ ID NO: 1919 - DNA, 3893 bp, Pinus radiata
aggcttattgggcgcgaattcgaaactcaaagataagcacgccatctccagacgacggcgctgtatcgcggcatgctcgagaagtttcccggtgaacaggggcagtctcacggggcccgagcaggggacatacgaaaaccggcccacgccgtcgttttggcaaacagctgatcagacttgccgggaaattgaaattggggggtctatttttagcgggaagcttgaaaaaacagaacccttaacaataagaatttagtgctaccgtggtctgaaaaggattatagagagctgcggagagcagacgaatcgggggagaggaagcgcattgaggtttacaacggatatgaatgaggagaatttaggagatttgtcagagtcttgtgttggtcaggcagacggtcacatggcaaaggggggcaccggcacgggcaaatcaaaacgagaggcggatgccgaacccgtcgaggatgagtttcgctgcaggcggaacgacgggaagcaatggcgatgcactgcccgtgcgatgcccgggcgttgcctctgccagaagcaccatttgcagcagctgttgcgggcgcagcaggcgttggcgggcactaagagcactaagagcactaagagtaaggatgaggaagcgcattgaggtttacaacgcattgaggttccgagagtactaagaattcgaagccgccagggaagaagagagggcggaaaccgaagatacgcaagccggaggacgagggacaagaattccccgtgttggaatctgtaaagcgtttgaagaggaagagaagaagaacgaagaatgaggatactgatcgtgatcccgtgaaaaggaagaagagagccaagaggaatgatgatgacattgtacgggattcgaccgaggagccttcgcgtaatgggcgcccaggttcggcggaggctcctttgcagttctcaaaggtgttcgataaggcagaagctaatgtggattccggtgaacaggtcgagtttagtttgccggaattcggtgctcggactaagagaaaatacgtcaagaaatctcagaataaagcggttccgtcaaaggaagaggatcctgagtataaacctgtaagaagggggaggaaaccaaatgggaaagtccgtgcacgggatttgactatggaacctctccataatggatgtcttgatgtgcccaatgacttgatggagattcctgcccatgcagaggatgatttttctaaggcgtttcgtaaggttgacacttctggacaggttgagtttagtttgtcagatcttgaggcaggtcggtctaagagaaaaaatgtgaagaaaatgaagaaaagggcagatcaggagcttcaagaatcttctttgcctgaggatattgctgatgaagagaagccaatgaattcatcatcagagagatttagcttgatgtgtcaccaatgtcagcgaaatgacaaaggaagggtggtttggtgctccaaatgtagcaaacgttactgtgtctgctgcactgaaagatggtacccctttcaaactgaggaggagattgctgaggcctgtccattttgtagggggaactgcaattgtaaagcttgtttgcggcgaggaagccgtcttaaggtccgcacgaagcagacaagcaaagctgatatggttcattattaccagcacacgatttgtatgcttctccctatgctgattaaatttcaagaggagcaaattaaggaacaagttgtggaggctaggatccgtggaaaatcagcagaaaacatggagattcccaaggcgaaaattgcttcagacgaacgcctttactgtgacaactgcaatacttcaatcgtagattttcacagaagctgcccagattgttcatatgatctttgtattagttgttgtagagagcttcgagaaggctgtcagcctgggggtgattcagcagagtcatcccagcagcagtacacaaagagagtttacgcccagtcagagaataagaaacaaaagaaaatagcacggggaagcacaggttgggaacgtcggttgcagtctgtcaacagtcacactgcacatccgcttaaaccattgccagattggaaagttaatagtgatggttccattccatgcccacccaaagaacgtggtggttgtggagataatttgttagagttaacgagcatgtttgaatcaaattgggttgcagaacttgaggagaaagcacaaaaaattgccagtagttgtgaattgccagagacattaagggattcccagccatgttctctgtgcttcaagccaaattctcaggacaagattgaactttctgataagtcaaggagagcatctaacaggaaggatagcagtgacaattatatgtattgtccaactgttcaggatatcaaatgtgagaatcttcaacattttcagaagcattggattagaggtgagcctgtgattgtacggaatgtgttggatgatacatccggattgagttgggagccaatggtcatgtggcgggctttcagggagactactaagggaaagttcagggaagagacaaaaacagtgaatgctattgattgcctggattggtatacggttgagataaatattcatcaattttttaaaggttatacggaggggaggatgcataaggatcattggcccgagatgttgaagttgaaggattggcctccctcaaattacttcgaggaacgtctaccacgtcatggtgctgaatttatcagcgcattacccttccaggagtatgcccatcctaaatgtgggcttctaaatcttgccacgaagcttccagcgaactgcttgaaacctgatttaggcccaaaaacatatatagcttatggcacccgggaagaacttggtagaggagattcagtgactaagttgcactgtgacatgtctgatgcgtcgtgtataaaggttgcccttgattttgtatcacctgaaaatgtacctgaatgtattcgattgactgatgagttccgcttgcttcccaaggaacacagggcaaaagaagacaagttagaggtaaaaaagatcattctccatgctatgaactcagctgtaacacaatttaatagcttgaccaaagttaaaaaggaaacaaagaaggggaaaaaggaaccggagttgatccctgctggtttagaaaatatggattcatctctgattattacaggaaaagaaaagtcaaacactgctgatccagaggaaatagagttgacttctgatgttccaaacaacgtggagttgagtccctctgttccagaaagtgggaagctgatctctgatgtttcagaaaaaatagagttgatccctcctgtcccagaaaaagaaaagtcaactctgactatgccagaaaaaatagagctaacttctagtgtcacagaaaattgggagtcgaatcccactatttcagaaaatggggagccaagtctggctgttcaagaaaatagggagtcaattcctgcccttccagaaaatgggaaatcaattcctgcccttccagaaaatgcgatgttaattactgccattccagaaaatcatgagtctactgtttcaaaacctgtgaaggtgggtcctcctgtttcagtaactttggagaccatctgttaaaatgaaaatagagtcatttcctgtttctcaaggaagtgcaaaaagcctgcatgcagtggaaattgagcaggaaaggtgttgcaaattttgttactgttcaaatttttcggttgtaaaggttaggttccttgtggaactgtagatctatgtggatgctgagctgcagttttgactttattatgctgctgttgcgaaattggcattttcattatcttgtatatttatatatgttcaaatgaatccttgtcgcaggtttccctgtaaaaaaaaaa

SEQ ID NO: 1920 - DNA, 1349 bp, Pinus radiata
accttttggctacatcctcactatctttccatttggtaaagttgaaggggaccgagtgttattttagataaaagttaagacatttatgaaatccaaatctaaaaccagcaaaaaccaaactcagtgtcgatctcatcgatcagagtagaccacaagtatttctggtgtgaatcacatcggagatggcattcgcaggaacacagcagaagtgcaaggcatgcgagaagacggtgtacgtggtggatcagctcacagccgatggttcagtctttcacaaggcctgcttccgctgccatcattgcaatggcaccttaaagctcagcaactattcttcttttgaaggggtgctgtactgcaaacctcacttcgatcagctctttaagaggactggaagtcttgacaaaagttttgaaggaactcccaaagctgtgaaaaatgagaagttgaatgatggtgagattaagacacccaacagggtctctgctttgttttctggcacacaagagaaatgccttgcttgtggaaatacagtttatcccattgaaaaggtttctgtggaaggtgtgggataccacaaggcatgcttcaagtgtatgcatggtggttgtgttatcagtccctcgaactatattgcaattgagggcaggctttattgcaaacatcaccatgctcagctcttcaaagaaaagggcaattatagccaacttatcaaaactccatctgtcaaagaagtatcagagaattcagtacacgagtgattatgcagctgaagtttgacaaaattatctttggtgcaattatccccatttgtttgttagcaaggtgcaatgtacagtttaacatgactattggggacattggtcttttatttcagtgatatggtgtttcagcaaaactattttcaaattaccttttacaaatggttgttttgatctgtgagttggagtgtttcaatatttataatgcctatgggattggtacagctgagtattagactattagttgaggcgcatatactaagttgagtccatgcacggaagacgctgctgctgttaagtggctattagtggcagttaccgtaactcacttaatgctcctgtctatagcaatccgtgttatgttttaaaattgatgtgaaagtctggttgaggaagaaagaagcagcggttgtgctgatcacttgagaatatgttatatcgttcaatatttctcgaaaacattttctgaggtttgagatttgtattatttcaaggcctttgaatttgcctataaactgctgttattggtattttttaactgttatatgtataactgccctttgatttggtactattcaaacaaaaaaaaaa

SEQ ID NO: 1921 - DNA, 1038 bp, Pinus radiata
ctttctctctggtgtggggagcactcaaaaggggaagacgaagatggagattaaacgcattcaaaaccctagccgccgccaggttactttctcgaaacgcaagaacggattgctaaaaaaggcattcgagctttctgttctctgcgatgctgaagtcgccctgatcattttctcggaaactggcaagatctgcgagtttgcaagccacgacgacatggcaacaatactggaaaaatatcgaatatacacggaaacacatggaaacatggagtcctcgtcggtccaaagcgtgaagattggtgaatcacaactcaaagcgttgcgtgagaagatgaacaaactgaagaaaaaggaacgaaacatggttggtgaagacttggattcattaacgatgaaggaaatgcaacgacttgaaaatcaattgcaaattgggataaaaagaatttctgataaaaagatgaaaatattggtacaaagttccaagtcattactacaaaagacgtttcaaccacccgatgactttttcactcccaaccttctgcactgtttactctgttgcatccatatacattctacaggtacgcgcgttggaagaggagaaaattgaacttgaaacgaagttgcgaattaaaggctattccttcagttcagccactaacctaaatcttggactttcgtatagtaccatgcccagcgggctctgcgacatgaacagcaatggagattccttctccgttgagataccttaatcgaatacaataactaaaatttctcagtacggatctatccactatttattgcagcttcttcaaccaaatcatgtattagaagtccccaaacgtatatatatatatgagacggtcatgtatattttaatccttctgatttacagaaggtcacttccccatttccatattgttaaactaaattacacagaaaagtgacattttaccatatgttaagcacggagcaccatgtggctgctcctatttgcatataaattaagcgtggatgaaattttaattgtacatgtaacag

SEQ ID NO: 1922 - DNA, 60 bp, Pinus radiata
tcaagtcgccacccaagttaaagtgcaatgtaatcactttagcttggagtaaactacctg

SEQ ID NO: 1923 - DNA, 1724 bp, Pinus radiata
gaagacgaagatggagattaaacgcattcaaaaccctagccgccgccaggttactttctcgaaacgcaagaacggattgctaaaaaaggcattcgagctttctgttctctgcgatgctgaagtcgccctgatcattttctcggaaactggcaagatctgcgagtttgcaagccacgacgacatggcaacaatactggaaaaatatcgaatatacacggaaacagatggaaacatggagtcgtcgtcggtccaaagcgtgaagtactattcaaggactggtttaagaacgtgccttgttatacagtctcaggatccaactgcagaatatttgcttggtcagaagattggaactactcctactcctataggaaatggtaacctacaagctgttcggctagaatccactaagatgcttcttgaaccccttcatcgattaaagaaggcagatgctaggcttaatttaagccaaggagttctggatgaggttgtgggcgaggaactcggtgtgctcccaggaatggattcagtttttgcagtaggagccttggagaggttgatacaatttattggaggaaccacgagctatacaaaagaactggatcgcaaatttgatatgattatttatgatggaataagctgtgaagaaaccctgcgaatggttggtgcagcagagagatccagatggtacatgaggtatcttcgtaagcttgctgagaagaccgatacagggagagttacagcaccttcacttctaaaattggtagaagcttccctaaagccagacagcacagtggattctggttggcgaaccgctgctgaaatttgggatattgctgacaacatgctagagaaaggatcaagagcatttgcagacccgctaaagttttcctgttaccttgtaatggaccctagtaattgtatgtctgttaatgctgcattgagatattggggctgtgcaattcaagctggagctcatgtatctggtgcattctacccagcttccccttcctatagctcaatcaatatgtcaattgatgatacgtttttcccattagtgactgcaagtgtcccttttctgtcaatggattctacaataaactgggacattgccttgaaagatatgaatgcagatgcaaagaaactgcttacaatgaataatggcagtgggagaaacatatcatcagtgacatttgaccaaaccaagaagacagtgacccttttcttgccaggatttgacaagtcagaaattaaactgtcccaatggaggggaggatcagaattgctggtagaatcgggtgatcaaagacgtgtcattactttgccctcgaaaatgctagggaaggtagcaggagcaaaatttgagaatagaaatcttgtggtaacactgaaatagatatgagattctgttgtaaccatgttgctagtgatatttatattggaaagagatggatctaattctgcaagaagaattattctgatcctttaattctgcaagaggatcagaattgctggtagaatcgggtgatcaaagacgtgtcattactttgccctcgaaaatgctagggaaggtagcaggagcaaaatttgagaatagaaatcttgtggtaacactgaaatagatatgagattctgttgtaaccatgttgctagtgatatttatattggaaagagacggatctaattctgcaagaagaattattctgatcctttgatccaaaaaaaaa

SEQ ID NO: 1924 - DNA, 867 bp, Pinus radiata
tatcgttagcagtcatcatgaggtcgcaattttagcgcctctttaatatctgctgggtgcttgttctcattgcctggaaccagatctacaggagactgtaattcactgttttgcactgtagaaaggagaggacaagaatggtgaggggtaaaactcagatgaggagaatcgagaacgccaccagcaggcaggttacattttctaagcgtaggaacggactgctgaagaaagcttacgaactgtcggtgctctgcgatgccgaagtggcgctgattgttttctctcccagagggaaggtccatgagttcgccagtcccagcatgcaaatggtgttggataagtaccaaaagtattcacaagaaagcggaataagtaataggacgaaagagaaaaatactcaggaacggatgctcactgaacaaaatgtttttcttcgtaaaatgtgtgccggtagccaagatgattcagatttgacaacacctgcaatccaccttgaaagtataagaatggagcacagtgaagtcgagactcaattggtcatgaggcctccacatgtacaaaaaaatcacctttccacgtatagtgttcattaatcttccttcatttcaataagtttacatgataaaattactattactgagcgtgtaatttttcttttcatattttgattatacaaataaacattgtagctgtaggctctatttgttagtattttgtaaatcaaacaagcgtaaatacaggtggatcaaggttgaaagctgacctccctttgcgggagggaattttctccctctgcatattatgaaaatttaatgcgacatttgaaaaataaagatcatttataatccattttccctaaaaaaaaaa

SEQ ID NO: 1925 - DNA, 1848 bp, Pinus radiata
gattcgactggagcacgaggacactgacatggactgaaggagtagaaaatgggccgaactccccgctgtgatcaaatgggattaaaaaagggaccctggacacctgaagaagatcaaatactcatctcctatatcaacaagcatggtcatggaaattggcgtgcgctgcccaagcaagcaggacttatgcgatgtggaaagagttgtcgcctgcggtggacaaactatctgagacctgacataaaacgtgggaacttcagtctcaaggaagagcagactattattcatctgcatcaaatccttgggaaccgatggtcagctattgcctcacacctccccggaagaacagataatgagataaaaaatgtatggaacactcatttgaaaaaacgcctcctgcaaattggggtagacccagtaacccacgcgcctagaggatacaatgtatctaactgttacaccgctgtgaatatccgggaccatcatggcgagcaggccgatcatcagctccaaagccatgtctgcgtttcagaaccagtaaaaaagactttccaaaaggaaggtaacagcattgaatcccttgcccgccaacctctgcaggaagccaaggctcctcaagatcatggcgcatcgagtaattcgcctgtaattcacaaaacacctgatgatcaaaatatgatgagttctgatcagcatgaagcctattacagtctcaactcctcaggtaataattacacgtattccagtgactcgtcccgagtactctcaacgaaaccaatggaactcgtttctgagtccccatttggagcctgcagtgccacgaataaagagcagaacaacagtggaaaagtagctgctgtaatgccctacgattatagcaaaacaagtgagaagaaaatgctggccgtcgattataccagtttgcttcagtctagctacactgattccttaaagtttatacttgatgacgatggagaagattcgaattccagcgagtatcatgtcaactggaagcctttggctggaaatcagcagaatttcgtcagcttgggaagcggagaatttcgagaagatgacaaaccagtcgtgcaacaggcagatccagaggtcagtgtagggtacgattcttcgatgctaaatagtaacgttgagttctggagacatgagctatctctgtggccaacaacagaaagtaacacaatgggagaaccagctgtggcctactcatcctcgaatggcgcagcaccgcctgtgatcgggcagcagaaaaaggtaaaagtggaaccctcgggtaccaatttctccgtggagcaatttcttgagcttgcagatcataccatgggcacaaacatggaatgcaaaagcaatatttatgatcgctggccagacatgaacttagcagatcaggatcagggaatggagtactgggtcaaccttcttaggcaagtcggtccattgccattcctcgagactatagctccacctgacctttagcccttcatttctgcccccgctctaccctaagagttaagggctctttctttcatttctgctcccactctaccgtaagagttaagggctctctctttgatttctgccctaagagttaagggctctctttcttatgctatgtttctttccctctctcacgtgatcctcttttctctttcgatcctgaattaccgggtagcatgcagtacatatctggaatgtcctctcaatttcattttaaatggcaggggttgctttaaatgatttgtgaactaggtattgttcaaatctccctttgtatctttacatggagtactggagttttgtattttgtctaaaaaaaaaaaaaaaaaaaaa

SEQ ID NO: 1926 - DNA, 1238 bp, Pinus radiata
acgaggccagagctgtggctgttcccagaagaggatatcatcagctgtccagtttgtcctaagagactacagaagaagaatatagaagatgggtagatccccttgccccccaaaagaagcgcttaaccgtggggcttggacaggcatggaggatacgattctcaccgagtacattcgagttcatggcagtggtggctggaaagatatctccaaaagagcaggtcttaagaggtgtgcaaagagttgcagattgcgttggctgaactatcttcgtcccgatattaaacgtggtaacatttctcccgaggaagaagagctcattattcggttgcatcgccttcttggaaatcggtatgtagagaatcgggggacatgatttattcatgcgccagaatttcacgattcctcatcgaattagtcatgcaatgtttgtgcaggtggtctctgatagcaggacgactgcctggtcgaacagacaacgaaatcaagaattactggaacactcatatgagcaagaagccatggctgtcaatggacgaatctcagtccaatacttcgcaaaatctcaaaacgaggtcaaaatctccggttccggtccaaaatcatgtgttcaaaaccaccgccctgaaaataaatccggcagcgagattctccggaacggtaagtgcagatggctacagcggtgatggctgcagtaatcatatatcaaatgaagccttcaatttctgtaatgttaaagagactaggaaattctcatggcgcgagctacttatgaatgattccatcagagacgaagaatccgggaatactgctttcgcaactactaataatcccgtcgaagcagaagccacaaattctctctcttttatgtcagatttagctgaccaggaatctccaaatcgcgatcattttcagggagatgcaattactttatccaatagtttattgtatttgaacgagaaatcatttccaaactgcaatctgctcccctctccatccgactgttcaacagattttgcatcggaagaattctacagaggaatggaagaattctacgataacgtacaagatgaagattggattcgtgaattcgattattaacagaaatgaaacctactggaacctgccgagcaatgggagagctacagacgaatttgaggtagaagaccgtgaataaatcccatgacaggacatgttatcaataaaatttatatgaggaattttgtttaaaaaaaaaa

SEQ ID NO: 1927 - DNA, 1391 bp, Pinus radiata; identical to SEQ ID NO: 737

SEQ ID NO: 1928 - DNA, 2362 bp, Pinus radiata
gattcgactggagcacgaggacactgacatggactgaaggagtagaaaacgctgatataaggttctttgtatttctgggtctctggaatttaaaccggaacagatgctgtgggcttagaatttggagctctgataatggctgcggttgttttgggcagcgaagcagcctcagcgtctgcctctgcctctgcttctgcctctgcctctgcctctgcttctgcctctgcctctgcctctgcagtcaaggaacaagcaatagaggaagtgggtaccttgaaaaagggcccacggacctctgcagaagatgcgattctggttgagtatgtcagaaaacacggtgaagggaattggaatgcagtgcagaagcattcagggctgtcccggtgtggtaagagttgtaggctgaggtgggctaatcatttaaggcctaatctgaaaaagggtgccttcacagcagaagaagaacgcataattcttgaactccatgccaagcttggcaacaaatgggctcgtatggctgctcatctacctgggcgaacagacaatgagataaagaactactggaatacccgtatcaagagaaggcaaagagcgggcctccctctgtatccgccagatgtacagctccagaattcaaatcaaaaggccccacaaacaccgtctgagcctaataatatagatttaccatatgagagtcgcccttcaaataatcccttgatcttcagctctaaggttgaaaatggtactcctagctatgatggtctgaagcatgctaatacgaatcctatgccattttctgggttgggtaatgtttccatgggccctttgttttatcaagcaaatccaatccagcgagtcaagagagttagggacactagtttcatcatgggacccccttccagccctttcggtcgcatgggtgtgaatggtcacatggggatgaatgatgtcagtaagagcttgcagcctggttttaaggccagagttccttaccccctccaagctgctagatcggattcattcgttgctcaaggctgctttccctatgaccctaatctcagcagcactagtaatttgcccctgggagggttttcatcaggcagccatgccgttatgaatggtactttctcttcttctaggcttttttctggccagaagctggagctcccttcaagccaatttgctgagtctgtgcagactgcaggctcaagcatcaatccagttttaaataggagcactcctcttttgctgccgcccgttcctactcagacgatcaatcaagtagactacagcttctctacgccaaaaaatagtgggttgttagaatctatgttccaagaagctcaaacaatgggtggggttaaggctcattcctcctcaaattcctcgattgacctgcaggggggctccaaaagcagtatcagtaacccactgaacaatgggtttcctatgcagatcaagataaagcatggcgataacagtgacccaactactcccttggatggtcatactttctccatgtttagcgaaagcactcctcctttgggtactagtccatgggatgattcgtcgtccgcacagtcaccaattggaaaggccatgaagtcagaagagccaaatgaggggtatatttctagtggtagttgtggagatgaaaacgtttcttcaatgttggatttaacagcagatgtattaccggatacagattggaatgctcaaatttctggaatagagaaagaccaatcccttcttaatgatgccctgaataccatgttcagtgatgatttgggcatgggtgttcaacagatgccatctgaaacttcaccttccaatcaaacgtggggacttggttcctgcccttggagtaatatgcctggtgtttgttaagcagcaaatcttcattgactgttcaagtacgttggtagcaaaatgacaatttattgagaagtcatactaaagtagcgtgcaaatatgggttagtattttgtgatttttgatgaatggtggaagttttgatggacagttagagctcattggagtgccaactaccaatcgtgctttgatgagcatagagaattaaggataggtgtcgaatactatgaatatttatggtgttctagtgttttactcatgtggtgcaagtagtctgagttaggttttcaccagcagagatgcatattatgtaggaagtttggtttagatatattgtgactaagtagctaatgtgaacttaagcggtggtaaattctagtcaaatttgaaggttgtgactacctgaaacttatctggggatagatatcctaccattcgtgctttaaggaatttgtatggctatatttttaagtggccactctttcaaagc

SEQ ID NO: 1929 - DNA, 2599 bp, Pinus radiata
tgaatacatggtttgtccggtatcctttttgcgtgtctatttgagggttattattcttctgctgcaactaatcagaggatgctccataaaattggtatttttagccggcaacctcattttgggattaccatttgtctccattagcctgattcttgcactctgatagtcggttaaccttcttttacagttttgggttctcctctttctgaactcatttcgcatcacgattgctccattaccttctgtacctctcatctggtatctcatctctttctttaagccctgattggggccacgaccttattctacaaatctaatcatgttttatttttttggtttgctgtacagatcattgtttccagaagttctggctcatgtgcagtatttgtttattttattagcatctggggtctctgcgtaatcatcattctcttgtgggtatcacccctattattattaacatttggggtctctgctcagtaaaagtgctgttgtggctctctccccttttattagcatttggggtctatgcatattaggcattcaattgttggtctgctctgttctcgtttctttctaaatgcttatacaggttgtggtctgattcaatgtacattaatttgatttctttgatttctatgtttgctcctgtgtttttttgtggtgtgcagtaatgtccacatttagtacttttatggttgcacaggttttaacttgaatgtggcatctgcagtctgctataataagcattcgttatgtcctgttgattctttgatttgtgtggatttcattcttacttgtgcatcctttgaagtaggagtcttgatgttttcttccgtattcatgctcctgcgtcatttattttaaaactctgtatgtgccctaaaactgtgtattatgcaatgacaagaaattccccagaccctcccacatcttcaacacctgcaagctccagatggagcagagagcaggacatggcatttgaggatgctcttgcagtgcacgacgagcaatgccaagatcgatgggaaaagattgctgcacttgtccctgggaaggatgctgcagaaattaaacttcattatgagatcctagttgaagatatcgagtgcattgaagcagggcttattcctcttccttcttatgtttcttctggagaagggagtgctgatcaagctgtggaaattcaaggtactaagaatagatcacattctgcaaactttcaaagtggcgatgtcaatccaacaagaaagggtggctctaaggcggaccaggagcgacgcaagggaattgcttggaccgaagaagaacacaggttatttcttcttggactggacaagtttggtaaaggcgactggcgtagcatctccagaaattgcgttatatctaggactcctacccaggtggctagtcatgctcagaaatattataaccgtctgaactctgcaaataaagacagaagacggtctagtattcatgatatcactagcgtgaatgatggagacacatcaacaccacagggacctgtcacaggtcaagagaatagttccgcaggagctgcgggaaagcctcctaagagtttgtctcagccatctctaccaagagttgttgcgtatggacctcctgtgggtcaacctattgctgggcctgctagttctgctgttggtactccaatcatgattcctcctggacatgttccttatgtttcaagtggaccttttccaggatcagtagttcctggtactcccatgaatcttgtgccagtttcatatgccatttctcagccaacaatccatcaatagaaagaatgcaattgctcaaaattaagcaagggactgaatctaacttgtacatgtaagtgtgctctttatgttcccttatggtgtaatgtaggaagcagcactgctctgtcaacaattctgtatatgctgccaaacttgtttattgttgtcattaaggaccatatgttttagaggtgaaagagttcaagatgttcttctgtacaaaagagttttttgagatgaaattcattatatctgtgtgtcagatattgatagaattggaggtaatggccctaattttccttcaaatctggtgctgttttagaaattgagttgtcaacctaaggtcaaaaacctcaaacttcatgaacaagttgtgtatattcaatattgacagattggtacatggtgcactgaaatgtcaatgtcatttgataattttcttgtctttttgaaacaaggaaactgagtattgtaatacagttcaggaagtttgtaggtttgccatttcaaattcaagccaagtcatccttatcattttggcttccatggcagaaaggttgtatctgttttgtttccgttaaagtggtccacaattgaacctgaaagatggtctttccgggttttaagagctgcaaattctcattctgtacttgatgttatgatttgccatgatcttttgtaactcggcatcctccaattgtaggggaatgatatgatccccaataatgcacagaatttgataacatctcctggcatgaccctacttttccttcaggggcagtgtaaataagcatgattaaagtttaaaaaaaaaa

SEQ ID NO: 1930 - DNA, 1688 bp, Pinus radiata
tgaaatacacttcgcgtacgtataataacctgttagttcttcaaattcaaagatggtctgccctcggaggtcagcgccaactcccttaaaggttgagccctctcgactcagcaccatcttggaccccaattcagatacttacgattacctacgaacaagtagttctgaaaaaatctattgaatttaaaactatcactcagtgaggtcactgatctgccaaagcgaacccacccagttctgaaaaaatctgttgaatttaaaactatcgctcattaaggtctcccatctgccaaagcgaccccctgcttatttaaaaccagtgcatttgctcggatcaatcagtgatatattaacatgctcgtctgatatttcagtttagacatggattactacgacgaagacccaaggccccgttttcagttgcaggcatcctccatacccgctccccaacaatctgcttcaatcgacagaaaacacgcagcattttgcatagcaacaggaatcttaatcttcagttacggctgccttttgcccggcatttggcagatcttactgacatggatcggcttgtcacttgccattggaccgttcgccccgatttccctcaccggtggcgacatcagagtcggctgcggcgaaatcattgaagaaccacagctcgaaaccccaaaactggaacccgaacggaaaaattatagaggaaaggccaagcggtcagagaacagtaatcccgaaatacccattttaaatatccccagatcagacgaaattccggaaggaaacaaaaatggagaagcaggtgctaaggtttctgtggtttctagggtttctgatgacggagaatggacggcggaggatgttgaattgctgaagaaacagctggcgaaaaaccctcctggtaagcccggccgctacgaggccattgccgaagcttttagaggggcacgcagcgtggattccattgttaagaaggccaaatcgctcggggaaaggaagctaggggatgatgattcgtttgctaagtttctggcgcagaggaaaatttcagacaaaatagagatgaatttggcggagggcaaagatttagcggatgatgaggaggacaaaggtaagaagttcgggtggagctctgcagaagatatagcacttctgaatgctctgaaggtcttccccaaagacaccaacatgaggtgggagaaggttgccgctgctgttccaggtaaatctaaaacacaatgcatgaaaagattttctgaattgaagctgaattttcgcaattcaaaggcatcagatacataaaggtacgggcattcacaatatggaggagaagaggaagattttcgaattctagagattcatttgcagagagagggagaggaagagggtttcttgttctttgaagggtgttgaaatgtatgcgcgctgtaacggaaactgcaaaaggaatggccagtgtgcacttccaagccccgcagccatagtgagaatatgggcgtctgataagcattgagttacttgggcggcccaaaattgagaaaaataaagcgcacaaattttctttctttttaggaaatatgctgatatgaatcaacgatggaaaccctttcactgctcgaaaaagataggtttttttaagtaatttaattattgccgaattcttggatttcaatgcagatgtcctttctgct

SEQ ID NO: 1931 - DNA, 4077 bp, Pinus radiata
ctgcaaattgtgttcttcagttagctattagctaatctgtaaccggaaaaatttctagattggagcagtttaccttttgctggaagtttagtggtggtattcactgatgacaacatggtttttcggtctttccgagcttcggcgtcttgattttgatcattttttgaaggcggccagcggaacctctcctgtgtagaaatcttagtgaaaagctttctttggccgtgtctagcgtgcgccggctttctaatgagctgttctacaagaaacaataggtagacgctagtattttattcaactattcaagttaccgggatcttattagcgttgccttcatttcggagagcagagttgagtggttttactctgtcgtgcatctcatggcttcttttccagccgtagcggttcctcaggaggaaagaactgaaactgtcgcagggcgtcaaggtattgaaaacaatggtgtacattattccgaacaaagcaagtcccaatctatcagatttccaagtgacgaggtctcttcgtcaggagatgagttcaccacaaaggttaggaaaccctataccatcacaaaacagcgagaaagatggactgaagaagaacatcataagtttttggaagcattgaagatgcacggccgtgcatggcggcgaattgaagagcatattggtaccaagactgctgtccagattcgaagccatgcacaaaagtttttctctaagttggaaagggaagcttcagcaggaggtgtacccatgggcaaagcacaggatatcagcattcctccaccacgacctaaacgaaagccgagccatccatatcctcggaaggcaggcactgctagtcaaattggtccatcaacaaatgaagaggagaacaggtcactttcagcagtttcatctgcacctgacagattgtgtgcaggttccaatctaggtggtgaaactcagaagaacgcagcatttgctccatacaatgcaagactgagaccacttcaaacacatgataacatcaacttgcaggaaacaaatatggaatcatccagtacaagcatttcaccatcaagtctcaagctatttggccagacggttttagttccaactaatgagtcaggcttagatgttaatgttaaaggagctttccaagagtttaagtctcataagatggagagacaattattagatggtcaaattcctgagagttcaaagttggaaaagacgaaaggatctttgcatagtgttggtgtggaggctaaaatgaaagtagttaaatctgagaatgcctcgggggtgacatccaatattccagcatcagaatcagggaccagtatgctcgaaggtagtggtgaatcaaatgcaaatctgccctgcagggaaatccatacagcacagcaggactcggatgagccgctatctgaactggataacaacatgaattccctttctagagagcatcaagcctctgttcctgtctccatttattcgagacatattccagtacaaaatgttgaaggagaggcagaagaatgtgtggcaatcaatacactgaatggtaatgggtcattgtctgacacaactgggaagatgaaggcatatgttcaaacttcacagcttaatgtttttacaccatttcctggcatgccaggttctttcaatccagcatacaacaatttggaaagatttggatgtattccaggattcgttgctcctggcactgctcccaatggttctttcccgccatggcatcttaccccatcagcagccttgcatcatccagcatatgctgcagcaacactagcggcagctgcattctggcctgggttggtctcaggagcctctccagtggcaacaggagatccacagccaccaagagaagggaagaatgggcattcatttggtgaagacacaagtgcaatggcggcagttacagcagccacagttgctgctgcatcagcttggtggaccttgcatggtgccattccaccaccttttctccatccaggtatttatggtcctgttgtagcagcaatggctgctgaagctgcagctgttgcagctgcagcagcagcttctggaagttcttcacctttatgcaagacaggacctgtaagggaagcaagaaagcatgagaagatgattacaaccgaagaagatggtgagatattagatgcaatgcctgccagtcctagtgccaatactaaaggaaaactaagcatggaacaattggatgatggcataccaggtttgtcgtgtcccaagtctggacatgctgatggtttgccagaagttttaccatcaagttcagatcccaacataactagctgtaatgaagagtcatgtgatgtagaaatgcagatagagaaaccaaattttcaagtggaagaacaggatgataatgcattttgtatcaacttgcctgagggagaaactacaaacagtagaaaggttataaaagaaaggtcatcaagtggttcaaatacaccttcaagtgctgaccctgaagttgatccctgtttggggatgaacactgaagtgaagggcaatagtgaaagggattttgagtttaactgggttggtagtggaagctctgatgcaggaggagaagaggcattggcaagtaaaaggactaattgcattttacctgaaactctgggtaaaactgaaagagagaagaataatttatcgacaaaacaggatgggaaagtggattataatggaaattatgttaataaagatagatatcagagttatggaggagatgcagcaggccatcgatctaagtcgggagggcatctcaacgaaacttggagggaagtttctcaagagggtagaattgcatttgaagcgttgtttaaccaagatgtcttacctcagagtttttctcactgtcagaatcttagggatcaagacaaagttcccaaagttagcaggaaatctttttgcaatgatgcaaagcaaaaaccaagcaaaacatctagagatgaaatacaagatgatgcccaaaatatggtagtaaaccagaagcaagcatgcagtggtgtacatgcagaagattgttcttgtgcccacaaaattgctttgaaaccagctggttcacctactcaagttaaaaagatacaggactcagaagctacagacaataattggtcattagaaaagtatggagaatctgaaaggagcttactgcaaaacaagagtgtagcagtagattttaaaccatccaaatcctcagttatctcaagttctgggaatttcaggtctggacgaggctttgtaccataccagcgatgttctatagaagcaaaaaaaaacaggttgcatacaagacccacacaaaactgtcaagatgacgaaagagaagaaaaaagagtgcgcttaaaacaagaagtggaagacggataaggaaacactgattcccctttgtagcttgctttaattcatccaaggcaggtttattgattcttattcaaaaggtgccaaccaatcttactgtagtttccggacagcatcaagtgatatgtctggactctgtacgttattgttgtcacaagtaaccatctctcgaagataaccactaatcggtatcacaccttcaaacactaatattttcatggacttgatatattggcccttatcaccttagacctgatagcaattcagatctcaacttctttcaaacctcttttgtttttcaccccatctcagctgaggcagtgctgctgccatgtcggcaatctcattttcttgtatgtctcatagggggccagcttgcagacccccagcttgtgcatataggttctgtaacctgggagactcattgcacatttgatcatatgggatgcaaagggacgagggccaatgatggcacgaatcaaaccctaaggatatggatatggatatgttcattcatacacaatcaagatttgtatgaagagcagcagaatgaacaacctacatagaaggtagaatgtcacgcgagaccttatcgtttcccaaatttgagattggtgtattctataaatgtaaaagtaaaatatttgaaaataatgcaatctttttgccctcaaaaaaaaaa

SEQ ID NO: 1932 - DNA, 1302 bp, Pinus radiata
gctgctggttgggtatttgttggatcgatcaggtcatagatcatgggtaggtctcctggttgtgggagcccttcaaagcatgaggagcatctcaaacgcgggggttggactgctcgcgaggacaagattttgattgaatacattaaaactcatggcactggtcaatggagaggtcttcccaggaaagcaggtgagaattttgacctattatgaagagtagaatgtccatgaataatgcgtatttgtagactagcccgtacaaaaataagatattgttaggcctatgagacatagcagtatatatggtttgatttactaaaaatattgtacaccactctaccaagcatctctgaagttcctcgaataaatttatctttcctgaacaagcttgagctgaagcaattgtttttgcaggtctcgaacgaagtgggaaaagctgtagattgcgttggttgaactatcttcgtcccgatattaagcgaggaaatatttcccctgaggaagacgaacttctcgtcagattacatcgtcttcttggcaataggtatgccactcggtttttaagaaatctgatgacaatctaattttatatataatgtttgcataagcatccaaacgaatttaatacaatcctttcagtgatctatatatatatatatatatatatatatatataatctgaaagggtgattaatatcacttagtattgtgcagatggacgttgatagcagggcgactccctggtcgaactgacaatgaagtaaagaattactggaatacccagctgagcaagagggtccaaagaggtgaattcgagcccaaatttcagaagccctttaaagaaagggctattccttctccgtcaagttatggtaaagtagtcgtaggtacagataattatacctctcaaattctacccttgaaaacaagggcagtcagaccctctgcaagggctataacagatggagacaatcttcatagttatgattatgatcatgtaccggataccaattatggtattaatcaagaaggctgtttgaaagcattagatgatcatgctatggaaatagatacttccaaatcatggtgccaattattgttggaggattgcttgggagattctcagtacaaccaaatggaagaggttaatgcccttcaaccaatcagcatgacaaacactagcaatggaacagatgatcagcaccagcaccagccccactccccttccctctatcaaagtataatattgcaggaaaatgattgttcttctggttgtgactgattcagcaggaatgcccacga

SEQ ID NO: 1933 - DNA, 564 bp, Pinus radiata
caattattcacaacagttagcatttatcaaggaaaaatatacttcgttttgtgttctcagtcgtaggagatataccagtaccagtacattatctgcttgcagggtaagttgaagttcattacattgcaatgccggtgccttatcgccctcatggccgtatttttaaagacaaatcccacgctgcttcagcctgcaacaagctatctttactctcattacactgatacataccactggtcaaaacttcccatcactgtcataggctggaacagagaaactgaagcctgttcaaatttttcaatacttttagatctggtaaagaagccaatgtgagaactgcaaatttcattgggtcaaaactcaggtgtactgtcaaagcatgaaagtccagaatttgatggtgggatattcaacatacggcagaggtgcccacaatgatgtaaaaagtattgggctgggtgcctattaccacttgcagtggtgtaggaaagagtgtagttctattgcaggagtgtaataaatgatgtagatatttttctccacgattgagttcaatatagactc

SEQ ID NO: 1934 - DNA, 1257 bp, Pinus radiata; identical to SEQ ID NO: 726

SEQ ID NO: 1935 - DNA, 2162 bp, Pinus radiata
ggtcgtcaataataataacattgctcgccccctagctcgcaaggttgggccgccccgactttccttctcttggccagctttgcatataaaaaccatttctcattggtctgtgtatatagttctcagacagtcggcataatcaaaatcaatcccctggagattggtggagcagaagctttgcagcagctgctgccgttgaagcggaagcagtcattgtttgtcgggtcaagactgtattattatttccagaggaggaacatctgtgatttgttatcaatgtgggattgaaattatagtgcagaggggaactggtagtgtcgtcatatttggtattgtttttggggaaaaaatagggcgggggaaaatggctgtggggaacacaaaggcgccgggatcagagagcagtgggtgtggagagagggggcagagaatcaaggggccatggagcccagaagaggacgcagctctccagaagctggtggagaagctgggtcctcgcaactggtccctcataagcaagggcattcctggccgatctgggaaatcatgccgcctgcggtggtgcaatcagctcagcccgcaagtgcagcaccgccccttctcccccgaggaggacagaatgatcatggaagcccactccatgcacggcaacaaatgggccaccatcgcccgactcctgcccggccgaaccgacaacgctatcaaaaaccactggaattctaccctcaggcgcaaatgcctcgccgagaaggacagcagcggcggaggtcccccctccacctccgctcccgtccccacattcaccatgggaggagagaagcgaagcagcgccgatctactgtcaaatgatgacgggggaagcgctcaggaggatcaagatcaagatcaggatcaggatcaggatcaggaggggaatatggaagtggaatcgcagagattcaagaggaggctcaactacagtcccgagtctccagctaactctcataccaataccaacaccaccaacagtcccccagtttccacagcccaacaacaaatccaccgcccgctacccctgcaatccgccttcaaatcttacagcaacaatctggatcctccaacgttactatctctatccttgcctggctctggcatgaaggaagaagattccaaaactgatgacagaaatcagaattcagccccaaagaatcagctgcagcagaatgttgagctcaatggatttgcaggtacccaaacccagacacagcagcttcaatacacattcattcctccctactttcagcagccagtgatgacacctacaagcacaaatggctacttgaaaacagatgatgccatggtcatgatgtcagaggctgtgaagatggcagtagggcaggcagtttcattggtttttcaggcttctcaatctcaatgtgggagtttaggcgcagttgaaagaagcgggtttagtgctagcggaggactcctggatatcatgagagaaatgattgccaaggaggttaagaactacatggcgatgtcacagccgaatcagtgcaatcagaccggtggccttaattgcgcaatggattcctctcttccaaggaaagtataagaaattcaactcaaaacataactgtgatggcttaaggaccataattcattctatcaggcgaaatcaaagaaatgcttgtggatgcaagcccacacaaagcatagaagaagaaattatgatgaactatataaactgtctccgaatatatagttccagcgtttttgggattgagaagctctggtgtagtagaacactattggaataatgaaattttttggacaagtcctaattcatcagcttgtgaacaaaatccatcgaccacaaaggcctggtgtgggtattgcgttagggctttatgatgttgcagataaggcttttgtttcttcattttaggtgtataaaatatttggtagcaatgatattcactgaagagcatttccatttcctttgttaatgaaccagtaagtaattttgtctcacatcttccttggctgctgcaccattggagtctgtatatggttgcattctgcaagcctttatcaatatctccatggtgcccattcaaatgcttgaatcttgtatgacttttgttaatctaaatcccacttggtatataaaaaaaaaa

SEQ ID NO: 1936 - DNA, 1588 bp, Pinus radiata
ataaattagtggagatattactttggagattcttactggatgagatatcagtaaagaagggcaggaaaacaaaattaacgactattcgtcccattctcaactaatttttcaaagtcctgaattgcctgccacaaccacaggtcactagttggaaactatgaacgcgcataaaatcgaaggcgaggagtgctagaagaggcgttgaagttgaagttgttatggtgggaattatgctggtcgggtcgacgatgattcctgcgggcggtgcggcggcagtggcggtgacgtcggtggaggaaggaggagaattgaagaagatacgaaagccctacaccatcaccaagtccagagaaagctggactgagcaggagcacgacaaattcctcgaagctttgcagctgtttgatagggactggaagaagattgaagcatttgttggttcaaagtctgttattcagattcgtagtcatgctcaaaaatactttttgaaggttcagaaaactggcaatggagaacatgttcctcctccaaggccgaaacgcaaatcagcacggccttatccacaaaaggcttccaaacttggaattctagcttctgcgcaaaattctacatctggacttccctcttcaacaatgccaggagaatatggattttcacttgtttctcaatcaggtgatgcatttacatctcaagacacgtcatctcaacctgtttcgtcttggattcatcatggagtaccccgaggaactgatacatctgggttaatagtggcagatgtaggtaataccaatgttaatggaagaaatggtaacagtagtgatgacagctccacaaatgaatggtctctacaatcaactccagatcagatcaatcaagaattttgtttgaaaggtactcccgacttttcagaaatttataagtttattgggagcacatttgatcctggtgttactggtcatctgaagaagttgaaggagatggcacctatcgatcgggaaactattatgctgctaatgagaaatctctcaataaatctttctagccctgattttgaggagaataagctcgtgtcatctccttgtgatatgaatgtaggagggcagaggcctgctgtcacaaccattgtggatgggcaagttgtgtaggcataaattgtggcgcatcaattattataagattttagaagcaggaaataagagttgactctgcagtcctgttgtacatgcttttatatggtctggttgagcccaagaaatggctgaaacaaactggatggtagggtaactcgagatgcaaactaataagcagaacttagtggcacacatttcagcttatacccatgttggagccatctatgcactcacaaagtgctactgccaagtttttttcttattatttgctgtagttgattacaatgtacattaacaacagtataacttttctgggaatgaagtaaaaatactggaggcctaataatttgcatcaacctatcctacaatattgctagtctctttatttcatcaacttatgttgtaacatcaacctatcctacaatattgctattgtctctattttctcaaaaaaaaaa

SEQ ID NO: 1937 - DNA, 1390 bp, Pinus radiata
aaacaatcatcacgagatgaaattcccttcagaatgggatttctgagattcgatccttgatctgttgctgcgatctgatcacattttattgggggtttagggtttaagttttctctgctaatggcatcgatgaaaggaaaatctccgggtcacgatgagcccgatcggatcaaggggccttggagccccgaggaggacgcagcgctgcagcatttcgttcagaaatacgggccacgcaactggtcactgatcagcaaagcgattcccggccgatctggcaagtcctgcaggcttcgatggtgcaaccagctgagcccccaagtcgagcaccgccccttcactcctgaagaggacgccactatcgtgagagcccacgcccagcacggcaacaaatgggccacgattgcgcgcatgctcagcggcagaaccgacaacgctatcaagaaccactggaactccactctcaggaggcgttgccaaggtgggggcgccctcgtcatcgacgacgagatctccagcggcgccgacgggtttcgaaaacggaacctcagcgaagacgccgatgccagccggaaattcaagaagctcagcctcgggacgacgacaacgaccacgaccacggagcctagcacctcctcggcctcggatcggagcgactcaagtctggtatttggctcccctcatgtctacaaaccagtgcctcgtccagctcctctggccctgactagcgaacccaatttaaatctaaatcatcacgaggcctcctgttcgagcaccgacccaccgacttctctttgtctatcgttgccaggcactgacgcccctgcaagacctagcgttgtccccattgccctgcccttgcctgtcacttcttctcctgttgctcctccgggatacatcaaggctgaagaagccatggaatggatgaactctgccataaacaccacattgactcaggtgcttaccccttttctagccccagctcgttcacatgggataatgcctgaaaccctgggctcctctggtttactggcagtaatgcaagagatggtggccaaagaggttcgtgattacatgtcttcaatgcagcaccgcaacaacaacaacacagagttcaggggttgcgttgcatctcctcctcctcctcctatgggattgcgtgtctccaactccaatgccctgggttaagctaaaccaagctgagacaaagactggaatagctgccaatcaatcaatcccttgagatggtaatccacaattttcctttgcaaaactttccttccttcatttaaactccacaatgaaggcaatggcattagctgtgatgtcctctgttatgaacacttacttgccccaataattctgaagcaacagaaacccaaaaaaaaaa

SEQ ID NO: 1938 - DNA, 1816 bp, Pinus radiata
aacctgcgttacacagtggttggagagcgcaccttcaagttcagtcacttgcagagaggagcaactggtaggtgggcttaaacatgagtttcacaccagggccagaaaaaggatcccccgtttcctccaaaccagagatacaaaaaatgaagaaaggtctctggtcacctgaggaagacaaaaaactcgtccaatatatgatgaataacagccttattggctgttcctggagctatgtggccaaacaagttggtctccagagatgcggaaaaagttgcaggttgagatggattaactacttgcgacctgggcttaaacacgctgcaatttcactccaagaagaacaattgatcatatacttacactccattctgggtaacaggtggtctcaaattgcttcccatctgcccggacgcacggacaacgagattaaaaattactggaattcttacatcaagaagaagcttaacttcaagcagcacagtctcccctgttcctcctccagcgaagccgccagcaacagcagggaaaccaacatcccctctcaatttgatcacacatacaatacaaattcagtgtctgcaaatgcttatgatgcttatatgggacctcactctgccaaaccatcggaggtcctgcctgaagggtacctgcgggcacatgatgacatattttctgccatgattactgcagaaaaccagcactcttgcgttcaggacgtagtggatttgaagcatgagcaaaataatgagtttgaaattgctgcagaccccaccaacaaccagctaatttcttgttcacggctgtggactgatcctacttctactcacacgagcaacagcatttctcaggcttttactttcccaggtctgcaagcgcaagaatattcttataaatctgcaaattcctcgagatgtgataaattagtagagccgtggaatacattacaatctcatgaaatgcattgctctgtcaataactctcttggttgttccatcactgttccttctggtgttgagatcagcaactccttgaaagaaaaaagtgaaagcgatggccatatcattaatgaaaatgagaacgagatcatgatccacaattcgtcgttgtcagcatcttctgtaataactccatggagcgttggtcattcctattcaaatgcagcggattgcagtattgtttgtccgggagattatacgagtaacaaggcggaagattacgtaagccagctgcatgagtcatacctaccacataattcccgtccccaattcagtgcaccagaaattctatggaccgacgttgatcagcactttaacattcaacctcaggatgagaatgaaggagagggtcatgcatatctgagatatggcgaacagaatttgggggtaccaactcatattaaaattgataggctgaagcgctatcagtttcctgagatcggaggagtgcagcaggattgttcatcaatggggaatgaagaaggcctagcagcactaactcctactatgttcagaggaagaaaaacgtgcagatttgaaagtgaaggcgaagcatgaaaagttaccagacaggacgaccatgtgtaaaatacttttgatttcgatcacgccagttaggaggagatgcaatgcaaatgctttcctcgcgtccctttgaaattgacttaggagttttttaatccggagtctaattatcttctactaaaaccagtgtctgttggaaatgcagtaccatcgcagttctctcgtcccctatgaaattgacccggatgtgttttaatacatattataattctattcaaacgtcaaaaaaaaaa

SEQ ID NO: 1939 - DNA, 3596 bp, Pinus radiata
ttccctgttgcttttagctctctggcttgccaagtttcttttctgtcatatctcgcttaggttcactgctggtcaagccctaatttgccagaaacgtagacacaagtgcgaaatttggaacatgcctttcctttcgaggaaatgacaggggttaaagtaaagagagagggcaagaccaacagagctcaaagctcgcatctctacctaggcaatgacgatggattacaaaaattagagccagtaacatgctcggctttggaggaaacgacaagtgatgaagtaaagagggaggaaaaagcggagaacaaatctcagagctcgtctctctccgtgggcgctgaccatgcattgcagaaattaccgcccgtgcacgggcggacaggaggtcctacacgacgctcatccaaggggggatggacacctgaggaggatgagacgttgaggagagctgttcaatgtttcaaggggaaaaattggaagaaaatagcggaatttttcactggtcgtactgatgttcaatgcttgcatcgttggcaaaaagttcttaatccagaacttgtgaagggaccatggacaaaagtggaagatgaaaggattgtggagcttgtccgtaagtatgggtgcaaaaagtggtctgcaattgcaaagcatttgccagggcgcattggaaaacaatgccgtgaaaggtggcacaaccatctaaatccagcaataaataaagatgcctggagcttagaggaagagttgtcactcatccgtgctcaccaaatatatgggaacaaatgggctgaattggccaagtttctaccaggaaggacagacaatgcgataaagaatcattggaacagctcaataaaaaagaagctggattcatatctggcatctggtcttgtgaaacagtttcctggtttgactgttccaaagcctacaatagggtctgcctcctcaacaggagggtcatttaatgaagttcaaggaggagcagatttggaagagatatctgaatgtagtcaagaatcgacttcttctcattgtcatttatctggttcatttatggggccttcttcatcatctgtgcaagtgggacttgaaagatcagaattgcgaaaggaaacatgcaagatgaattcagatgatgaattagaagtccatcatgaacctctgtggtcattaaattctaaaactgatggtttcttgctgttacaagatggacctgctggttattctaattctcccatacctgaagcagtgcctcctgtatcatcttgtgaattaaatgaacttacggagtctgttataacaggaaatagctgctctgttggcagcccaaaagaagtctctaatgctgttaatgtgtcaatgtctggggcttctggtggccttgaatcttttggcttcgagcatggagggtcaacatctgctgcaaaagacatggtctcatcctcagcattttacacgtgtcttctgttggactcaactgatatggttggcatgtcacataatctgtgtgccccagtttttgtggattcattgcatccaatttctccaggttcttcagatatgatgttgaatagccttgtcagggtaggggatggaatctgctcaacagaaatgccctcttctgttctgaatggcggtatatgtgatggtgcaggatgtgttcaagtcgcctctgagtttcagcatagtgatgagatgttgcaatactgtaaacctgttattcatgatttaaaggttgactgtcaggatggtagatctggtcctgatatgttgaatttgacatttgatgagaaagcagtcaatttgaaggtggaagcttcgaatgtgcaggcagaaagtccaatttctgagtgtttgttctatgaaccccctcgtctgcctagcttggagtttccatttattaactgtgatcttataaattcatgtagccatcttcagcaggcatacagccctcttggtgttcggcaaatgataatgtcatcggttaactgttctactccttactctatatggggttctcatgacaaaagcccagaatctttcttaaagagtgcagccaagagcttcagaaatacaccttccatattaaggaaacggcgacgagagtcttcaactcctgtgcagggtgggcaacatgacaagaaggaggccagttcagtagaccatgacagttttctgtcacatggttcattagatgaaaaggagaattcattgaaggatacctccagtgcagatttccagaattcctttgctgaagatggagtttctttgccgtcaagcaaaaaacgaattattgtatccccaccatattgtttaaaagcaaaaagtacagtgcctggaaaatccaaggagaaacagttattgcatgcttttgaaggtacaaactatacagaagttaaaaatgggtgtagtgtggatattggtgttgtaggtaatcatcaatctgacattggacggagtggaaaagatgaaatacacaaggcgagcattcaatcgagttttgagaatgtgcaaacaggcgggattcttcttgagcaaaatatgaatagtccactgttctgtacaaatggaaataattcatatcaaatttgcggcatgagttactctcctctaactccaaaaacactttttggtagaagatcagagacacctgcaaaacgaacagaccacaaaggaacaatgaaatccacaacagtaattgtacagtcaacatatattgattcacctaatttatgtgaaaagaaacgggagtcaaaatcaatttttttggtttcaagctgtcaaactcctgctatgagtgcttcgaaaactattgatcgtgccattggcgaagattggcttaacaatgtccctgatttggacaacctcagcataaattgctgcccatttagtgtcgataaaagtcttggatctccttttgaatggaaatctccgtggtctttggattggacttcaccattggaaaagcatggaagagatctacttctagaggatatgagcatcctgacaaacagtgcagatggaagggacgatgctgttggattaatgaaacatttatctgagcatgctgcttcagcatatgcacaggcagaggagattttgtctaatgatgaaaaaaaattatcacaaactgtttcgtcagtccaagcttgaaattctaattttaatgaagataagggatcataaagaaaatatcccgcataagtattttagaggggagagtcccactcaattttcaagttacattgttgtgtgagaaagggttcacattttgtgctagctctatgtttgtgggatcaatgaaatatctctgtgagcttgctgcttcagcagatgcacaggcagaggaaattttgtccaatgaaactctggaaaagaatgtatcacgaactgttacattttcccgaggtttgaactgtattcttgataatggaatgtaaaaggggattgtaaagaaaatatcctggataggaatttatgagtcaagtgttccacacaattttcaggttacagtgtggtatgagaaagggttactcttggatagccttgactattttaggtatgaaaatatcgttcctttgttctaaaaaaaaaaa

SEQ ID NO: 1940 - DNA, 1747 bp, Pinus radiata
ggccagacataggggatgtcccgagcacactgctgtgaagaaatgggtttaaaaaagggaccgtggacacctgaggaagatcgaattcttatctcctatataaaaaggaatgggcatggaaagtggcttgcactgccgaaacaagcaggacttagccgatgcgggaagagttgtcgactgcggtggacaaactatctgagacccaacataaaacgtgggaactttagtctcaaggaggaacagaccatcattcaactgcatcaaatccttggaaaccgatggtcaactattgcctcgcacctccctggaagaacagacaatgagataaagaatgtatggaacactcgtttgaaaaagcgcctcctgcaaactggtgtggacctagcaaaccacgttcccagaaaatgcaatatatcttgctttgacggcgctgtgagtgtctgtgacagtcatgagaaggataccgatcatcagttcaaaagccatggctgcacgtccgaatcagcaaaaaaggttttcaaaaaggaaggcaacaacagcgagcctcttgcccgccaacctctgcaagaaaccaaggctcttcaagatcaaggcgtaattcagaaaacacctgatgatcaaaatatgatagattctcatcagcatgaagcgccctactacaatctcaactcctcgggcaataattactcctattcgagtcgttcatcccgagtactcccaatgaaaccaatgaaaattgtttctgcatctccatttgggctctgcagtgcgatggattataaagggaagaccactagtgaaaaactacctgcgcctgtgatgcccttcgataatattaaaacaagtgagaagaaaatgctggcgaccgtggattataccagtttgcttcagtctagcaacagcgatttcttgaagttgacacttgacaatggagacgtcaacagctggaaccctttagcgggaaatcagcagaatttcgtcagcttgggattcgaagaatttcaagaaaatgacaggacggtcgtgcaacaggcgtatcaagaaggcaatctagcttacaattcttccacgctatccctctggccagcagcagaaaataatttattgggagagcaagctgtggcgtactcattctcgaatgccgcagcagcgaatgtaagcgggcagcagaaaacagtaaaagtagagccctccggtactaatttctcagtggagccgtttcttgaactggcagatcatgatagcatgggcatggatatggaaagcaaaagcaatattttcgatcgctggccagaaatgaacttagtagatcaggatgatgggatggactactgggtcaactttatgaggcaagttggtcctttgccattcgtccagattatatctccacctgacctttagcccttcaattccgctcaactctaccctacggaataagggtatgctatttgttatgctgttcttttctgtctctcacgtgatcctcctgagagttaagggtatttactactgctctcccttgtatgtttctctgtctctcacgtgatcctcggacttacggtatgcacttctctctgtcacgtgatcctcgtgactgatgtgtttctatctcttctctcacacgtgattctcttttcttgttcactcgtcaattaccaggtagtctgcagtacatatctaaaacgtcctgtcaatctcatctctaatggcaggggtcaggcttggagcttcaaatttaaaaaaaaaa

SEQ ID NO: 1941 - DNA, 1791 bp, Pinus radiata
gattgggcaagcagtggtatcaacgcagagtacgcggggagatttgtaggtattattggcaactgaataaaccaggcaactacggtcttgaatgtacattgttgccccttaaagctgacaagccatggggcaccactcatgctgcaaccagcagaaagtgaagagaggcctgtggtcaccagaggaggatgaaaaacttattaatttcatcaataacaatggctatggctgctggagtgaagtgccagagaaagcaggattgcaacgctgtggtaagagttgcagacttcggtggataaattacttgaggcctaatattaggcgtgggaaattcactccagaagaagaaaagcttattatcagtctccatagcgttgtcggtaacaggtgggcacacatcgcatcacatttaccaggtagaacagataacgagatcaagaattactggaactcgtggataaaaaagaagctggctagatctcgactcgattccaaattacatgcagagcagagcaccagtaaacgacctgaattgtctcaaattttatcaaagcaacttaatataatcgaggaggagagaatattatatacgcattatagtaatgatcagtccccacagcctcagcttttcgtggcaggcaacagtctaaccgtatcaaaccaaaagcaagaagattcgaaaatgtcgcaagcattgggccacactgatatttcaaacgatcatgcagcttcgtcggcaggtatgatggaaaaagcattgtatagtatataccaaaagaacggcaaatcgaacctggagagttttgtccatgaacacaaagtgcagggctcagattcagattcagaattagcagccttggcctacgatagcgtgtatattgctccgtgcagccaaccacccatggaatataacagtgacaacctgggtattgcaggaaacagaattaatcaatatgcagatcagcagagaggtttgcaggggcctaagaatggaatactcactgggtacaatgcaggagaattgtcccatattgctagtactagtctggcctctgaaatgcctgcaacatcattcccttttcagaatatttgcaagagcgatgacatgcctttgcttcctgcaatttttagcgattattgctctctgtcaatccaggcggggtcagatcaacatgcccaaacttgcaattatttgccccagctcttggaacatggcgaagattggggagctaattatagtatgaaatattcaagcaatggtgttagcggcagtgtggatgaaatccaaatacccattctcagtaaccataagaaccagtttccagagttgaatatggatgaacaagagccatatctgaactcttccttgcagtggtatgaagtgccacattcgttttttcacccggagcacctcaataatcatgatggcatggaatcaatggagcccatctctccacctcacggatatgtcgacagacagcttctataaaactcaaatttgtttcacgattcatatatttctgcaggtacggtgtgctctacaatggcggtgtgtaattacagtataacgtactctcattaattaacagaaaaaacagaaattttgtgtttattggtttttaagtcagcgatgtaagaagaagaaggtatacgtaaaatttcagaatcttgaactctggttgattgaggcttttgctgcttattgtgagtggatttttgtgagcagaatgtataaatttttgaactgtgctcaatgaaatagtgttgttttatcgatttggaaaaaaaaaa

SEQ ID NO: 1942 - DNA, 2049 bp, Pinus radiata; identical to SEQ ID NO: 769

SEQ ID NO: 1943 - DNA, 1930 bp, Pinus radiata; identical to SEQ ID NO: 771

SEQ ID NO: 1944 - DNA, 2752 bp, Pinus radiata
actttactctggtgtgataagggagagggcaacggtagggtttcacgaaacccctgtaatgcctatgtgcaattactcaatttctgctgtattttaccacggcggagcttggatgccttctccttgttaaatagtcattgatttcccccggatttgaacggtgaatttgatacattttctggtctttatttttattgtttcattttttctttctttagtgtgttccgaacctccgctcgtgcctttcaatcgaaattggaggttggacattattcaggattttatttgaattcgagcaaaggttttattccttgtagaaagattcgccagaattgatttttacgatagacgtcgaagtgtaaatttgtagatttgtttcaattcgatggcaccaatttcgttgcctcctggctttggtttccacccaacagatgaagaactcgttgcttattacttgaagaagaaagtacatggccataagattgagcgtgacattattcctgaggtggacctttataagtgcgaaccatgggatttgcctgataaaatttgccttcaaagcaaaaatctacagtggcatttctttagtccgcgcgatagaaagtatccaaatggctcacgtactaacagggccactgaggctggttactggaaagcaactggtaaggaccgaaaagttacatctcagcggagcacaattggaacaaaaaagacactagtattctacatgggtcgtgctccatttggagaaaggacagattgggttatgcatgagtatcacctcgatgagaaggagtgccaagcagcaggtttacaggattcttttgtcttatgtcgtgtggtcaagaaaaatggattaggaacaaaaagtgatgaccagtctgttgccccaactgagaaaaatgattcagatggtgcaaataacaacacattacctggcattctggctgaaacattctgtactggacatcaatcaccagttttgcaagaaggtgaaaataaatcaaacttaaaactgccatctgaaacatcatctgagaatttaaatgacatgaatgaagagagtgttgagagatggttagatattcttctggatgatcccgatcaaaattgcagcattacatctccagctgagttgacaaataatgcaaaggttgacactgctcaggaaatacaagaagtaatttcaagtccactcaactgggtacaagactttaattggattccagctggtgtagactttaatacgcctggagacttggagcatcttcaatttccaaatactctggaaacatttgaggaagcagaaataatagaggaaatatttcatactgcgcaggcatctcaggaagataatattgaagctaattctttgttacttagtgattaccttgatgaaatttggggaggagaggaatatagagatgagtatcatgatacttctatggtgcagactggcaaccacactaatccagaggttactggaattcaattacgtcaaagaagccagatatgccagcaggaactgccctatcagggtactgccatgaagagggttcgaatgcagaaatatccagtgcaacattctgccattgaacatcaacaggatggatgcactgcttactctgaaaatgattgtatctatgatctacaagagcaacatatcttattagacagttttaacaggcagaaccataattccaagttatggcagaatatgacaccgcttcaagatccagtgccactagcttctgcaaggcaaatagatgctatcagagaaggtcattcaccataccatttgagaggtccattggcaaacgaaagtcttgtccttgatatatgggcttttcctgaatagccagtcttcagagatagttgatattcctgctgagtcccctaaccaaactatgaaacatgaaccgggcaatagtctggagatatggaagtctcagcaacaggtgttgacatcgcttactgaagataaaatgcccatttctaaaataaatcaccagacttctttgtcagaggatggcctgctctcaactgtagctgttattaaagaacatgagtttgtaccatctgaagatgattcagagacaccagaccagtttggtgaaccaattaagggttcatcatctggagaagtaccagatagttcaggagcttcatctaaagtggttcatccagagaaaattttaccagctccaagctcatcggaaccgacatctgtcagaggctggaaaatttcacaacgaatcttaaaattctgcagttctattccttcatatgcagctccagtgacggaatatttaggtcgatttaatcccaagaaagctattcttccttcagaatttgcatgtaattttggtccaacagatggtgtgactgatagtgctggtaatatgggaacctgcatgtgcactgaaggaaatatggagcatgccagatctaacattttcttgtctcagttgaaacagagagtgaagcctaaagtaaaaagtgttatgcctgatagtggagaagagtcaggagatgctatgaaaatgttttgtcaccgttgtgctgaccaaagtaacagtgctactctccatggtttggagccgccatcaggtgtactcaatggcttctctgagttttggaacagatgtgctccaacaagctctactagtgttattgtatcagtatgccttctaggcacaacaagtttactcttccttttcttgctgtttcgagctatctaggaaaaaaaaaa

SEQ ID NO: 1945 - DNA, 1453 bp, Pinus radiata; identical to SEQ ID NO: 763

SEQ ID NO: 1946 - DNA, 1563 bp, Pinus radiata
cttcttctgcaggatgtgtatgtaaaatcaagtgagggataagatcggaatttttggagtaaccactgtaaattcatctgtaaatctgcaatgatttcaccggagctgtcgatgaattttcccatatcttcttgcagtttgaaacgcaaagagtgcaaggcagatgaaagcagcttcaagcacaatcaggatgtggtcatgccgggtttcagattccatcctacggaagaagaattgttggagttttatctgcgcagaaaagtggaggggaagcacttcaacattgaagttattacaaccgtggatctttatagatacgatccctgggagcttccagctttggcttcaaatggagagaaagagttgttcttttacgtacatcgagatagaaagtataggaatggagatcgacctaacagagttacaaagtctgggtattggaaagctacaggtgctgaccggatggttcacagtgaagtctctggttgcatcggcttgaagaaaacgcttgtgttctatacagggaaggcgcccaaagggaaaaggacaagctggatcatgaccgaatataggttgccacaactcgaaactcgcagaattcagaagaacgaactctccctttgccgcgttcggaaaaggtcaggaaaatccgaggaaggaggttttggagcaaaggaacatggtaagggaacggaaactgataggacaacacttaataaagataatgttggaccttgtttacatattgaaatgcaggaatcaggtagcatgtgccagtggcagacctgcatggcatgcaacaacataagaacaacggtcgagtcttgtaatttggagatcaaagcaggaagtacagatgaaattgttaagctcgaggaaatgccaacagatataaaagttatgccaaaatcagtaactggggaggaaagatacccagctcaaatggagtaccgagtaacagatcagtcggaacacagtcaggaatgcatttacagcagacgggggaatatttgtagtagagtgaggcagcccatctctgtaaatgacgagcttgaactatctttgacgacatccttaatctgtccgagagaacaagatctgccgggcatgaccaaagatctctataataataataataatccatcttccctagttctcactaatgctttaactgatggtgcgtgtttgcaaactttcactgacaaattatgggagtggaaccctgtgagaagcaatggcagtggcgcatcctgctgattattttccaataatcattcgattcgttatgtagcagtgtttatctaactgaattagctttgaaattccaactcagtgtttatcttcattagagaggtgtcggaggacgaaggatcaaattccaattctcttctccaagagagaggtgtcgcagtaccaaggatcaaatttcacatgattattgctgctgttttccacaaagaggatacagtaataacttcctcacatgttatgaaagcagacagttgttttgtataaaccttcattttagtgttaaatacatttatttttggatcaaaaaaaaaa

SEQ ID NO: 1947 - DNA, 1306 bp, Pinus radiata
ctcgtgcccgcggacagcccaaaggaaattggttcgagagtcaaatctctttataagacaccaggcttagcgtttgaagaaatagcagaagcagtagcaggtcaggggatccagagtattgagaagaaaactttggcataagcatgggaagaagagatgctgaggcggacttacaattgcctccgggattcaggttcttccctacagaggaagaattgattgtgcattacttgtgcaggaaagcggccttgctgccactgcctgttcccataattgcagatgtggagctctacaaatatgacccatggcaccttcctgagaaagccctctttggagaaaaggaatggtacttcttcactccccgggatagaaagtacccaaatggctcaaggcccaacagggcggctggttctggatactggaaagctaccggtgccgataagcccatcacttctactgcttctagaggaggaaggaagagagtgggcgtcaaaaaggctcttgtcttctacgttgggaaagcacccagcggctcaaagaccaattggctcatgcatgaataccgtcttgccgagattaacaggcctgccaggaagaaagacaacttaaggttggatgattgggttctctgtagaatatacaacagaaaaatcagtgctgagaaattagcactagagccgaaggaaagcttcaatgatgtaccaatggaaaccattgatgaaaaggaaatgaaggatgagcccacctcaacatcattcaatcatagcgccattgaacagagcaacccgtcctttgaccatttgagaaaattgggaacttctccaacatgctacaacgcggttccccctggcgcttctcccatgaattccaatagctgtttccagaatatggatttcttacaaaattcaaccaccccttttagtggcagtacccttaaggctccagtgcagaatacagcattcaacccaatttcctcctcgcagacaaattgcaattcaacagacttaatttcaggattgtatgatgatttcagctgttccaagccatcatcattttcaaaacccatttgggacaaagaagaagttgagagcagcttcagattggagaatttctcgcagcagcagcaacaaccattagttaatttcgatctggaaggtctacaaaatcccttccctcatttaggccaattagattttagtgatgcttatcaagattggtttctatgctcatgagcccttccattgagttcatgaacttagaagaaggcttattggcctctaatcaaattacttttataaaaaaaaaa

SEQ ID NO: 1948 - DNA, 4591 bp, Pinus radiata
aattcaatgttataaattttgtatttaagcggaccgcatgaatgtaaaatttgaacaggagattaaagggacaaaggagaggcgggcggcgagggatctgatccgacgaagggggatctgatcgggcggaagattttgtttgattattgcataagacggcaacccatttaaagctgttgtggttgattaaatataaagaatacgaataaagaggtgggtgaatcccctattccttcctgaaaaaaatcttccatcaaataaaatatttgataattggggtacaaaatcgatgaacagtaaggaatgacgtgatcagattccatcgaggcggcctcagattctgtctaagcatccgaggattcccatttcgggctcctgttacttcgtcaagtttgcttcgacccatgttcgaaacctgcggcgggtcaactattgttttacagacagcagcaagtgctatccgggcaaatctgttttggagcttcaaaccgagctccgaccccatttaggtataacgaataagttgtctgcttcatttggaatcgagtttcagtatttttataaaccgtttgggaaccgtcgaaatgatttacgggcaaggagtcaaactagggcttctgattttcaaccaggcagctgcggtaactgaaccaaatttgcttatcacatgaatttgcacaaaccctgttgtttttattgcaaaactccaggcatctcaggttcgagccccatcagggtagacgaaaccctgaaatactaaatcccttcatggaacaacagcggcagcagcagcagcaacaaagtcggtggccttacgtagaagctcaggttccagcaccgccaaatttaatggcctctgcggatatagcaaggctactccctgaagacgctctgctatcagaactcatggagatggacggtttaatggacaccatttccgaaccctggccggcaatggcgtcagaatctggtttttctaactttaatttttcatcttttatcgcctctcctgattcctcgtcttcattctacgctgtatgctcgccctcggctccgtttaacgcacagccttctgggcttgttagggctgattctggagcaatgtatagtttaccttgtaattcatcaggattctcgccctcaatggtcaattcttctaccaccagccttccacaattgattctgcaagaggacgttttgatggcctccgcatcacaggatattccagataaacagattgacgatgttcggcgtagcctcagcccaagcacttcttgggagcagaggatatgcaaggatctaagttcaaaacaccaggaagcaacgtttgaacaatcggtgttggattttgttgcttctgatagcagtgccagtgaacaacagaagcaacaagatatcatgaaaggtaatttccggcatcagttgacgaaccggccctctggcacagtaaacggaccgagaaatgatatgaatttctggcatctatcaccgtctctcgcagaaagaatgcatgcagctttgtcgtttcttaaagaaaattacggagtgagtgttcttgcacaagtttggatgccagtgagacagggtgaaagattttatctaacaacgcgtgaacagccctgtatactaggtggtggactttctggatatcggcaagtgtcaactgcttacaccttcgctgcagaagaagctccagatgatttcccggggctgcctggccgggtttttatgcgggaaatgccagaatggactccaaatgtgcagttttacaataaaaatgagtatttgagagtgaatgatgcgcgggactataatgtgcggggatccattgcagtgcctgtttttgagcgcgatagtcgaaagtgtgttgcagtagtggaacttgtgacaacaacggagaaatttaatttcaacaaggatattgataatctctgccatgcacttcagaaagtgaatttaaggagtaaagaaatctggcatcatcctaaatcagagcatcagcgctattccaactccaaatgtcgtgagactgctttagctgagatactagaggttttgacagctgtctgtcagacacacaaacttccactggcacaaacttgggttccattcagacattatgaaatacctataggtgaggttacgaatacaggtagctatggacggatgttcttggcacttgaggatcaggcatgctatgtgggggatcatggtatgcagggttttagggatatatgcgctgaacatcgtttagagaaagggcaaggcgtccctgggaaagcatttgaatcaaaccagccatactttgcgaacgatgtgaagaattataacgtaatggattaccctcttgtgcatcatgcacgtatgttttgtatcagtgctgctgttgctgtccgtttacgaagcactcacactgggagtgatgactatgttttagagtttttccttccaaaagattgtaatgatagttctgagcagcaagtgttgttgaacagcttgtcaattacaatgcagcgagtatgcagaagtttgagaacagtaagtgacagtgaactgaagggagatggaaacaggggtcgcgattatgcacagaatgactgtacaaattttccatcagttggcatgcttcagaggagtcatgtaccagctcaaagagaacctaacatcacttcgtttcctgacaatcagttttgtcaggaaaaataccttcaggagggagcagttggtcacaactcgcatcaacggcaggaatacacgtcaaagaagaaactagaaaggaggcgcggtacaacagagaagaatataagtttacatattcttcagcaatattttactggaagccttaaagatgctgccaagagcataggagtgtgtccaacaacattgaaaaggatatgccgacagcatggaattgcaaggtggccatcacgtaaaataaataaagtgaaccggtctttggaaaaactccgaggtgttattgactctgtacagggagcagatggcactttgaaattaaatgccatcactagcgatataatgaatgcagcttctatggtccaagggttgcagatgcacagcaatattttaccctctcagggaagctgggctctttggccctctccagaagattttataacaaggaaggtggtaccagtaggaactgctgttcctttggaagaaactactactcaccagaaagaaaatttaaataacacaacccagactgtaatatcaactggcttggagtccccattatccttgaaagcagcatcagaagtacatagtggctgtgatattcatatgcaaaggccctcagcagatggaagtatttcatcaagcaaaaatgatttactagcaaggcatttcagagagagtgcccaacaaggatctctggcctatatgaaaggacaattggagataactgagaaagataagaatgttcaagggtttgttgggcatgaaattatgagaaattcattttcttctgttgccccttttggtgagagacatcagcctgtaacatacatatctgatactagtgatgaattgaattcgattctcatagcaaaaacacgtggttttgcagaaggcattgtggaaaactgccaacaagtgggacatcagttccaaggaggaaaacatgacagcaagagcttgaaaaatgttgagaatggggagaatctgagcttgcaggatgttgactatcaagtcacttctaaacactctgatttctttgtactaactaatagcaaagaacctaaatctgcagatgtggaagtacttcgccaggaacaaaatcttccaggcttttcagctatgacaaattcctctgctggttcgggttcaagttcctcgtcattgcagggatgtgattctagttcacccacagtcagtggtgtggatggtttgcagagagaacgacataataaagatgagagtttggtgattacagtgaaggcaaaatataaagaagacatggttcgattcaagctgcctctaagttctggattctccgagctatgtgaggaagtagccaaacgatttaagttagtagttggtacgtttcagctcaagtatcaagatgatgatgatgagtgggtgctattggcgtgcaatgctgatttccaggagtgcattgatgttatgaacttttcgggtgggcatgcaatcaggctttctgtacgtgatttggtcactgttattggaagctctagtggaagctgcggtgacatgttacagtgttaattcttgtatctagttataatgagcccaatttaagctgtgtccgggctgaaagcagaatttctcatctcattgtaaatatatatatgggttctagatgcgctagtaaaagagatgaactcctttcttgcctatttcatcttgctgttagcaaaatgccaatttgcaggcatcatcgtgtctgcatacctctgtacatgtaaatgaagagaaaaatgctgatccgtgaaaagacgatatttacacgtgagtatgtaaaacgaattcgtgtctaggcattggctggtctacgatatttgtcataacgagaatcttcaattttgaaaatgattgctatttaaaaaaaaaa

SEQ ID NO: 1949 - DNA, 2222 bp, Pinus radiata
gacgagaccacgccatttcaatttcacgtggtctagtcatccttaccaggattacagtcatgttcagctttaaatttctgctacgtttgatttcctaggagttagccaacaaagtagaccatttgtgttgtgtggtgatctgatttcgacacattgtctgtggggagcaatcctgaaaaagtgttgcataagcgatctgcaattttgagaattgcattctcatctgtagaattcggctctgcagatcatcagtgtctttaatttgtttttgtctgtgttcatattgggttgtcacatttctctggatttagctgcgataatgaagtatggggagaatttggagaatgacatggatggttcgaagcagccattcctgcagaaatcaatgccagagaaaagtaggagcacccatggagtttttgcgatgtttagagggagtactgctattgctattttgtgtacactgatagtagccatgggtcctctgcagtttggattcacaattggatattcatcacctgttcaggatgacatcacaagcgatctcagcctgacagtcactcagtactctttatttggttcactatccaatgttggtgcaatgattggagcaatagccagtggaaaaattgctgatggcattgggcgaaaaggggcactaatagtggcagcaatcccaagtattgtagggtggcttgccattgctgttacaaagaatgctttattattgtatgcgggtagattgttgacaggctttggaatgggagccatatctttcacagtaccagtatatatagctgagatagctccgaagcacttgcggggggctcttggtactttaaatcaactgtcaattactattggtataatgctggcatatttatttgggttgtttgtttcatggaggcttcttgcagttatagcactagttcccagtgttctattacttattggtctcttcattatcccagaatctccaagatggctggctaaaataggcagggagccagcttttgaagcttcactgcgggctcttcgtggccctgatgctgatatttcagttgaagaatatgaaattaggactgcagtggaggcaaatcagcagcaaaacagattcagaatatctgaccttattgagagaagatatgcactccctctgactattggcattggtttgcttctactgcagcagttgagtggaattaatgctattatgttctatggaacctacattttcaaatctgctggagtttcatcaagcaaagtcgctaatcttggacttggtgctattcaggttgtcatgactgctttcactgcatggttgatggataaagctggaagacggctcctcctcatgatctcagctgggggaatgagtatctgcctttttcttgttggtcttgcattcttgttggagacccatgttacaggagattctgacgaaacagcttacagtattttggccttaactggtgtattggtttacatagtttccttttctcttggtataggagccattccatggattattatgtcagagatccttcctgttaatgtaaaggatgttggcggtagtattgcaactctgataaactggttgtcatcttttgcggtgaccatgacagtcaatttactgttagagtggagcacttcagggaccttttggatgtatgctcttgttgctgcttttacagttttatttgttgcactatgggtgcctgaaactaaagggcgaaccctcgaggaaatccaatcatcatttcagtgaagttgacctggttatgtactctctatattctatcaatgatcgatgggtagattactccattgaaggcatcttggcagcttgttaacagaacaatggtggatttatttttgtattcgtgatgctttatcataccatttttaaatgtgaaaatgttaacaagtgtcaagggaaaatagcatccgtggggtagtgtaattatctcttctcctccccagtctattttgcattttcagagttctcagagcaaaaattattccggctctgaatttccaccgtaggatggcatgtgccgttatatgaagtgcggaaatatttgtttagcctacaggcaccttttcataataaactgagcttcagctcatcgtaattcatgcgttggttgttaattacattccaacattaggttgtaataatgatcttattccaacccatattttaattcttaaaaaaaaaa

SEQ ID NO: 1950 - DNA, 2298 bp, Pinus radiata; identical to SEQ ID NO: 495

SEQ ID NO: 1951 - DNA, 4483 bp, Pinus radiata
atgaaaaggattttgagaaatggccaccggagctgaggtaatgtcgtcaaatgtgctgggattttaactcttgaagatatcagcggattcttttgctaatttaaggctacgatgttgaatcgcatcaacagctgctgagctcgggtaagagatttcctgaagcaaagaagggaaccagttaggacattaaaaggattttgggaaatgaccgtcggagcagatgtaatgtcgtagaatatccggaggtttgatcagtaaagattggagtgtgctcttctgtcaagttatggctggggtaatgaatcaaatcgacggtccctagagtcacaggcatccagggagtgtcggcattcaagttttgtaagtttgtccaagaacctgctgaattttttttttaatttatttattgaaggccttttgaaaatggatggcaaagcagggccacaagtggccacgccattttttcagcatcagttactctcgggtcctttatacgagccttcattgggggctaagcgttgcgttgagcctgcggattcctcttggactcgaacaaactggcagcatcagcaacagcagaaaagtccacctgtttatgaagcgccgaagccgaattggaacgtcaatgtttgggattgggacagcgtcaggttcatcgcaaagccggctgatttggcaaaccatcgcgagccgaaccccagcaatattaaaccgcaggcttctcccgaaatcttacgtctgggatccaacgacatagggtcgaatgtcgtaaatggtccttcgtttccagatcaaaaaaggaagcttgatgaacccccgaagccttttcttcccggcaaagattcgtctgaaaacgatccaggaaacctgacattgaagctaggaggaagttcatactcatacgcagatgatacaaatccttcccgtcaaaacaaacgtgtaagatcaggttcccctggtagtgcttatccgatgtgtcaggtggacgattgccgcaccgatcttaccagtgcgaaggactaccacaggcgtcataaagtatgtgaaacccattcaaaagcttccaaagcactcgttgggagccttatgcaacgcttttgtcagcagtgcagcagatttcatccgcttcaagaatttgacgaggggaagaggagctgtagacggagacttgcagggcacaacaggcgacggaggaaaacccagccagaggacgcattgccccggggattgttggctgctagccaggagaacggtggtttagggaatttagacattgtgagcctcgttagcatcttgtctcggcttcaaggaaacaacagttccatggagaaatcaaatggacagtcgtctttggatggggatcaggtcgttcaattgttgaataggatgaactcctcgttcccttcatctcaaaaagttgctccaccttctgagggttttgatctgaacattgctcaaaaccttcaatcccctagatcagaggtccccaaggcgaacggcagtccatccacaggtttgaccactgaattactggctatcctttcagccttgacaggtccctctcatgatgccctcgccttgctcagaaacagtctcgcgactaacctgaaaggtaatctcaaagcacatcatcaaaacgtgttacctccctcccctactcctgtcgcacagcaaaaacctcaagaacgcgacatacaaaaccagaaaacaaatcttattgtggactctggcgcaaacaaccgcaagattaatgccacttatcaagacaactctcgcacacatttgccgcttcgtctgttcaattctttggaggaagacaactcccctcctaacgcgtttactcggaagtacttttcttctgatagcagcaatcctacagaacgatctccatcttcatcacctcctgttgtgcaaaatttgtttcctttgcattctggagatgaaagcagagaaaatgattgtgtttctgtctgtaaggaagataacttgacactagaaacaagtccgagcaatgatagatgttcggcctacgaactctcaaagcttgaaagtagggtgcataatcagaatttcatgtcaggatttcttcatcaatcattagagtccaggacagctgttgtgcagcctagctatacttcctcctcaggatcggatcaatctcctgctagctccaattctgactcacaggagcgaacagggcgcattattttcaagctttttgggcagcatccaagcaactttcctgtggcattgcgtgcgcagattctggaatggctctctcacagcccgtctgacatggaaagctatataaggcctggatgtgtgattctctcgatatttgtgtccatgccatctgcgaactgggaacggctacgagaagatctgccacaacgcttgaaactacttgttgaagattccaggactgatttctggagatgtggcagagtattagtgcaagctgagcagagattagcctcttccaatgatggtaaagttaggttctgcagctcttggaggtcgtgggatgctccagaaatttactttgttcagcctgtagctgttgtagctggccaagagaccactattactttaagaggccataatttggctactactggcacgaaaattctttgtgcttacagaggaaagtatacctctattgatgttcttcccgaagaagaagcttcagaatgcataccgactgattctagggtgcagaagtttacattttcaggggggccacctaatgtcttgggccgctgttttatagaggtggagcatggtttcaagggcaattgttttcctgttattgttgcagaccctatcatctgtagagagctgcaaagccttgaatctgagattgaaattgagttctcgagtgacaaaacaagctccataaaagttgaacgttcacaagaacattttcaaggttacagtgcagcaacagctagggatgaagtaatccgtttcttaaatgagttaggatggctctttcaaaagagtagcgagcggcaagctgaactaaacgttgtgaaggatgcttcttttcttgaattttcatctgatcgcttcaagtttcttttcatatatgctgtagaaagggacatgtgtgctcttctgaagaagcttttggacatattttttgaaatgaatgctgggcaggaagcttcagctccagagtcatccaaaaacttgcttgaaagtaatttattgcacagggcagtgaagagaaattgtaaacagatggtagatttgctcctcaactatgctccctcaccaaataacatgaatttgctgcaaacaaaatctttcatcttccctccaaacctgacaggtccaggtggccttacaccattacatttggcagccagcatacgtaatagtgagcccttggtagatgcattgacaagtgatccgcaagatgttggcttacaatcttggagtacagcactggattcaagtgggcagactcctcacgcatatgctttgcttcggaataatcactcgtataacagattggttgaaagaaaattggcagacaggaaatatggtcaggtatcaataacaatttccaacaatgaaccatctttagatgggattgcagcagatgtaaacgggtcgcacacaggttcgtctgtgttgtctttgcagaagcttcctcaaagttgtgcgcagtgcatgattttcagtaacaaaagagtgagaaggataacaggtagtccaggagctttgtatcgtccatatatgcattctattctggcaattgcagcggtatgtgtatgtgtttgtctttatttccatggtccaccacatgttggttcgtctggaccattcaagtgggaaaatgttgatttcggtcccgcttgaagttgttttatatatagccttcgtatgattgctgtacatgatgttgtgccattggactcaatattccaccatgaaggtgttgctgttattcacaatgtgctatcttgtcaaaagacacggtagcttgaggcggcagttttatccagttctgtcctgtctggatacagcaacaagagactgcaaaaaatagagagattattatggaattgcatatcctttcggggttctactatgttaagagctcattcatattcagttattttggggcggagaagtggggcaggggagtatcaatttcttcttcatatcctagtgttttgttcctccacaaaaaaagattctgaccggtagtcaaagggagaacatacaactagggtctgctttcttgttactttggatgatgctctggaggtaactactttccctgtgcagaaaatcccattttacacgcctaccatggcaacatttacaggcagatgatgtttctaatttccatatatctgatatttatgtactactcgatgctggtgcccggggcattttggaaatttttggctaaataagcgtcttattccagtgaataaccaaaaattgtggctagttcataaaaaaaaaa

SEQ ID NO: 1952 - DNA, 2035 bp, Pinus radiata
ggagaatataatgctatttcccaatagaggaactgacgttgaaaagagggctcaatgggaaaatgaaacagtaggtggtggggatactctgatggatgacggttcagtccataatgggtctgtgtattctcctggctgtggctctggatcaacttttgggtatgggtcatcttcaagaagctcggtttctgtggattgctcactcaaggttgagccagatctctgtagaatcaagacggggtccatggagtccagtgatatggaggacagggatgttgatttcttggacttgagaagccaagtaggacctagaacagatgagtcagagagaggaaagtcctctcaaaagagggaggatgtggagcttaatggcggtaagcattgctgtggcaccaaggaacatcaagagccacagaggtgttccaaagattctaaattcaaggctaggactggtcatgcggaggacaaggatatcgaaaacacggagaaaaacagttctgcagtaacaatcccagtttctgcatgctctggagaatctcatataggtttgaagcttggcaagaggacttattttgaagatatctctggagggggtcaaataagagcaacgcctatagcggctttccctggtcccctgcctactcgtgtaaaaaaaccgcacatgcaatctgcacgttgtcaagttgaaggttgcaatgcagatcttacgagttcaaaagactaccatcgcaggcacaaagtttgcgagatccattccaagtctgccaaagtcatggtggcgggtcttgagcaacgtttctgccagcagtgcagcaggtttcatgttttgtcggaatttgatgatgcaaaacgtagctgtcgaaggcgtcttgctggccacaatgagcggagaaggaagccacagcctgatccaatggctgtcaattctgccagatttgcgcccagtttctatgataacaggcatactggccttttgctagatgcatcatcctttatgcacccaaggattttttcaagttcagttttggatgatcgtgatgacttcaaacttggacatgggaaagggacctggccaaagattgttaaatcggaggtcccattgatgtttgatggccatccacaaacagcagctgttaatcggccatcatttaccaatgctctgtcttgtcaaagtgctgacaggctactccagctcttgcagagctccaaggcttcctctgtcagcgttctaagtcaaggcattcaacattatacacagaacccagccaaccctcttactgaggccttaactcgttcattctcgccagaaacaggggttattgctggtctagaagtagcaacggctacacaaaatttattaggagtctcagactctggttgtgctctctctcttctgtcatcgcagtcattgggctcaagggctctaggatcagcctcattagatctggccactcgaccaggtgccacattggaacagtttatgcatgagaatcattcttccatggatcagatctcactgcaaggaatgcaacataattttagtctagctaatagctcccaagcctctgcaggtctcatctctaatggatatcccactgctatgaattttattgataaggttcaagttgggtgactaactcctcatattgggggtattggaaactttgaaacccctatgcatggctttctgcaaggacaaggatttagaaattctcatgatgcaagatcaaaagctgttagacgtaccatcgatttaatgcacatgtcctcacagacacagggaaatggatctcagggacaatctgggatagtgcagcatggtagtaatggttccatgaacaatttatggaatttctgttgatgaggtgccgtgaaccatcacttttggacttacagcacatgcagctttagtggggtttatacgctttgttctttgctttcaacttaacaatatacctagaccttttagatttcagttatttatgataagacttgagtgtaattgcaacttttgttttcattgtcaaaaaaaaaa

SEQ ID NO: 1953 - DNA, 4427 bp, Pinus radiata
gtgtctggcagcaggtttcattgaaccgattggtgcttttgggtgtatttggtggtttagatctgaaggcaaacgatgcccagttgcccagttgcaggttctctaggtgaaaatgcaatagttatgatgagtgcttgtgacggtacaggtggggaaattgttgcctaggttcagggtcagtagaaggtaaaacgtttaggagttttatgaggcttgtttcagatcttgcgtattgatgtgccggtatagcgtgtttaaaattccgggggcagaaagagggtttttttgttgttgacttgtttggaagcttgaatctggttaaaaaaacctaatttcaggatttggcagctattggtaaagaatcggacttgcgaggtgtgcctagaggcttggattagcagaaattgatgcccaagtgcaggttttgacggtgtctggaagcctgggtgtggaaggagtgatcacgaaggcagtttggtggagattttgggaaaaagaagggatatttgtgtgttggatgaattacgggtgaggtgaaaagatggaggcagaaattggtagaagtcactgcgaagatcagatttatcagcagcagaagcagcagcagcgccagctttatgcttccaaaggttataatcttatgtcaaaggggaagaacatagtggaagatcatgaatgggatgggaataactgggaatgggacagcaatctcttcattgccaggcctctgagcactgacagaggatcgggatttcaaggtaaacatctcttatcagatggtccacggcctgctaatggcatttccaatgacatgtacaataaaggcggtgatgcgtacactaatgggtttcatagttataatatgaatgatgcatcagagaagaggagaaaggtgtcagttgtggaagaggaggaaacggcagaggaagaggcagcagcatgcttgactcttaagctcggtggaagtgattatcctgttacagagacagatgcagatgcggccagtggtgggagtaagaatgggaaaaggtctcgtgggctttcggcttcatctcatcatcatccgatgtgccaagttgatgactgcaaagcagatctcaacaatgcgaaggactatcacaggcgccataaggtctgcgagatgcatgccaaggctaataaggctcttgtcggccggcttatgcagaggttttgtcagcagtgtagcaggtttcatcttcttcaagagtttgatgaggggaaaagaagttgccgaagacgcttagctggtcataataggcggcggaggaaaactcaccccgatggcattatggctgggacttgtctgaatgatgatcgtggcagttactctctaattgtaaatctgttgaaggttctagctcagttacagacatctaataattctgaccagactagtaaccaggatactgtactccaacttctgaaaaaacttgctagctctgctagcatacctgaggaaaccaatgcagcagctgcaaaacagtccacagcaggccagccaaataataaagtctctctaggtggcccttcagaaaatacagttccattgcaaaacaattttcttgactctcattcgaatgcattcagaaagagtacagagccttctatctgtgcacgtgaacagtcttttgtttcaactcaaacgcgaaatgatgtactttttccacatgactctgcacagaaaactgctgtgtcagttgtacctcagtattctcataaattttggcagagacgggaaggtattcaggaacaacatgttctagctggatctgcaccacagtctttatcaatagaatctactgataagagaaagtctcccatatcaaacggttttgatttaaataacgtttacaatggacctgaagagttagttcctcgatcagatggtccttcaacattattgctgctaggaggacttgacagtgttagcaggcagaatgctcctctctgcagttcatgggcagcatcagacacttaccaaacaagtccacctcaaataagtgacaactcagaatcagtgtctgaccagtcaccatcaagttcacaaggagatggccaggatcgtactgggcgaatagttttcaaactctttggcaaaaatccaagcgaaattcctcaagttttgcgttcgcagatcctagattggcttgctcacagcccttcagatatagagagctatatcaggcctggttgtgtcgtactgacaatttatttatgcttatctgagtctctgtgggaggagtttgctaggggcttcaaaattagcttagagaggcttcttggggtctcaaatagtgatttctggaagacaggatggatatttgcccaactggatcatcaaattgcattcatttataatggtcaggttttgttggacatatcctcaaattttgctaatgctccactacttttaagtgttacgcccatagctgttcctgctggcgagaaagcacatattgtggttaaaggccgtaatcttaccagttcaacctcaagaattatttgtgcctttcaagggaagcatacagtccaaaaagattcaactgaatatgtacaagatgtcggtgttccatttattgacggaagtgatgattttgaaggatgcacacagattctatgtcggagtttttcctggtccccacataatgtcattgggagatgcttcattgaggttgaaggccatgatatgagtggtaatttctttccagtcatagtggcagaagcagatgtttgtgctgaaattcgcacactagaaaggtatattgatatgccttttaatagcaatcaagatgtcacaagccaaaatcatgatttgcaactgaagataaagagagaggcaataaaattcttgcatgaactaggttggctatttcagagaagctgctcatctcaatcaaaccttggcatcttgcccctgactagattttcacctactcgattgaaatggcttcttgagtattcaactgaacatgactggtgctcagtggtgcggaaacttctgaacattgtattcagtagcaatgtaaacagtgctaattggtcggccatcaccatgttgattgaagttggtattctacatatagctgtgcgcagaaattgcagggaaatggttgagtttctattgacttatgtaccagagtctgtggcagaggagacaatgttgacagctggacaaggacaggcagaacttagtagtaatggctttgttttcaagcctgacatgcctggacctgcaggccttacacctcttcatattgcagctagtatggagaatgcagaaggtgtgctggatgcgctcaccaatgatccaggccagattggagtaaaagcatggaccattgttcgtgataaaactggcatgactcctgaagactatgcgttgctcagaggccaccatttttacattgaactggttcgtggaaaatctgtaaaaaatgtgatgcctgaacatgttagccttgacattcctgagcctttgtcccagcaactgagcagcataaaaatgtcagtttctgcaccacgttcaacttcacaggcagagaaaataggtgaaggtaatatacaagggaataaagctgacacagagttgtgtcagaagattagatggcctggtggtctgagctggcctggtggtctccgctcagaccaaggtaagataaagcctttgccatctcattgcaaactctgtgagcagcaacaactaagaaaatacagatcaagaacccttatatacaggcctgcaatgctttctatgatggctattgcaactgtctgtgtttgtgtgacccttcttctgaagggaccaccagaagttctctttgtgacggctcctttcaggtgggaagtggtaaaatttggattcatgtaaagtctattttcagagtcaatgtagtcaaggctgtttctgcagttttatcaataaccgagcaacaaggctatggctgtggcaaccaaccaactttctgccaattgcagagcctagcataatcttttaattgttaggtattgttttcttctatggtttgtacattaatcattttattcattttcttaaataagtatatgcatgtattacaaattgagatagtttccactagtttttgtcctgtgcaacacaagtaaaatatgaacactatgcgctgcacctaaactgagatttactattccgatgtttcaatgttattatgaacatttgtctctatccagattatgctactgtcaacgtggaatgatggaaaacactggatatacttcaaagtgtacacttgtatataatttctgatagttggaattattgaaagctttggagatgctcatgggattattgtttaggcaagaaatagcagttgggatttgcaggacacaatggaaaatattacagatcagtttccactttaaaaaaaaaa

SEQ ID NO: 1954 - DNA, 2481 bp, Pinus radiata
gcaatcaattgtggggaatctattaggcccccttcggagaagtagaatggaatcgggaggaggagaccatggaaggccgccattaaagttaagcagcagctctcaagagcctaccatggcctcggcctcggcctcagcatatgagggccgaggagggcttgtaggttcatttgtgcctacttccagttcttctagagtagactctcacatgaatattgcatccacacagcctgtggatgcatccttggccatgagtatgtcttctgcaactacttcaaacaatgaaactcaaatatccacttcacaacaagagcaggagactgtagctctggacccaaacaagaaggccccagctaagcgttcatcaacaaaggacaggcatactaaagtagatggcaggggaagaagaatacgtatgcctgcaacatgtgctgctagagttttccagctcactagagaactgggtcacaaatctgatggagaaacaatagaatggctgctacaacatgctgagccagccattatagctgccacagggaccgggacaatccctgctaattattcaacactgaatgtatcacttcgtagttcaaattctagcatttcagcttctcatcataccaaagcactgcccctggcctttcatgggaccttagggctaggacccaatgtggacatgggtgctagattggaccaccaactgcgtgctaggaatgagtgggaaagggctgagaataggacttcaatggaactagcagtagcatcgaacaggcaatcagaggatagaaggctgcagattggtggtggtggtggggaaatgggtcatggtggtggtggtgatcacatgttaggattccatcaggagaatctgctcacagacccatcagagcatcatcatcatatgcaacaaggggggtcagagatagggcttgcaggtggtgggggtggtggggattcgagtgacagttatttgagaaaaaggttcagagaggatctgttcaaggaggagcctacagaagcccccaagcctctaagaagacagacacatgaaatggcaggccctgcaggtatccctcaaactagacccattactcctgctatgtgggctatggcctctgctacgggtttggccagcagtggacacatgcccggaggcttttggatgttgcctgtgagtgcaagttcaagcagtacacctggagtcatggccggtggacagtcagagcccatttggaccttcccccccacaggacccagtggaactgctacaatgtatcggatgccagccggggcctcaattcaccttgcaggcaccacagttggttcaggccctacaggtataagtactcttcaagcccctcttcatttcatgcctaggatcaatatttcaggtgcaggaatggggcttgagttccaaggtggccgcttgagtcatgtccccctaggttccatgttgctacagcagcagcagcagcagcagcagcagcatagctcccatcagttaccaggagccggactaggtctcggtggcggggaaacccatctaggtatgttggctgctttcaatgcctacaataaccgctccatgaattcagaccatcaatctatggattcagtccatcagcagcagcaaggtgcagacagcggcgatgaccacccggccaactctcagtagacctacataacagaggaccaaaaaaatatgaaggtattcgatttagtttgggtttgatttttagctgctcaggagttacatgattgatcatgaccttattgatgaccttattagtggttctaagtccccaacctggaccagctgcagacatctgcaacattggttattggagtattctattaccccatattcttgaatttaggatggatgctgagctgtgaatgaactccagaaacactagatacaggacaagaaacgaatctgattatcatcctcttgtaaccccaggataactgcaattccttctgcaacataggtttcattcaatctgatgcacacaggattacatattaattgtggatcccttattcggctggagttctaacacaactttgcaggtcatcaccatcctgtttgtttacatagagtctgagactctcagaaacaaactcggtttccttagtacatgtcttttcttatttctcattcttcttttccatagatctctcagcttctagagctgcttgaggtagtgttatttgttggtccaaaggaccacttgggtacagattgtataggaatttgttgaacagagcactgtgtctagtattaattctttgtttgtatgagaggcaataatttgcttgtgacaataagaagattgaatttgaaagtgtattgagtttgtgtactactagctgagccttgaaggccagcattctgaccggagtctgagccagctgtcttctactgtaacaatcttctgtgatacatgataatgaaattctggtttttcaaaaaaaaaa

SEQ ID NO: 1955 - DNA, 2389 bp, Pinus radiata
agtcccagccatctgaattccaagcctgagaaaaaattaagtagagcccatattgttacagagaagtgtattgtaggactagtaggagagtatatatatctgtaagtacatcttcaagatcccacgtatatggcacatggtttgctgctttaatagtgtattcgttcgtctctggtatggtatggcaatgtttggctccgccattggggactctggatcagttgcaaagtgccccgcacgtggagattgtatcagtagactgacaaaagacgccaccgaattgatttgagagagccagggcgctcaggccacaggcaggcaggcttaatctgttgtatgttgaagagctttcagggcgacggccggcaggggaaagtgtcggcttgggttgtctatgggtttgttttcttctggaattaatgagaaatccgggaatgataggatatgttaatcctgcagcatcgaaggagcaaaagggttcgaatctggattcggctggttcgtttacacaggctttggttatgagtagcggtgtagttgggatgggatcgaaccaggggggtgagacgaataatgccgagggatcgagtatggttgtggcggcgaggacttcccagggcgagagtggaagcgtagtggatcccagtaaaaaaccaccggcgaagcggtcgtccaccaaagatcgacacactaaggttgatggtcgagggaggcggattcgtatgcctgcgacctgtgcggcgagggtttttcagctcacgcgggaactggggcataagtcggatggagaaacgattgaatggctgttgcaacaggcggaaccctcgattattgcagcaacgggaacggggaccattccggcgaatttctcgaccctcaatgtgtcgttgcggggttcgagctccagcatctcggccgggctgaagcaacagtcgtatcatcatcatcatagggcgttggcaggcctgacgggcggcctcggagcgcccgccggtggggattctatggggcatcagtatcgtatgcgaatgggcgaatgggaacgggcggaggaggatacgaagacgcacgcgggggccgaaatggggtcgacacacgggggggcgtctgcggcattaatgggaggagggtttcaccttcagcatcagcatcagcaggagccaaatctgttgaacgagatgggcgaaggggaagaatgtatgaatctgagaaagaggtttcgggaggatctgttcaaggaaggtgatcaagaagcctctgcaaagccgctgaggggcattgtgcagagacagtctgagatgatgtcgagcccatcgggtataggaatgggaatgtctatgtcaatgccggcggcggccatgtgggcggtagcacctgcgccgcccgggatgtcgaacagtgggcacgggggtttctggatgttgcagcccgtgagcgcggggtcgaacagtaatcctccgcctttaatggccgcagggccacaatcggagcccatctggacattcccacccacgggctccacggggtatcgtatgcccgccggaacctcaattcagctcggagctgctgctggctcgggttcgagcttgggtagatcgagcaacaatggcaataataacaacaataatggcaatcaatcgcggatttcttcatcaactggtctgccgtttatgccaagaatgaatctgcctatgggagggagctgccatgaagtatcaggttctggatcgacgcgtttgggatcaggcgctgttcctttcagttccatgttattgcagcagggatcgagcactggatccatcggggcagcaacaggagagagtcatctgggaatgcttgctgcccttagtgcgtacaataaccgttccatgagttctgaacatcaatcattgcaggaatctgtgaatcaacaatctggcgtggatagatcaggagaagacggccacagccaccagaatcatgctaattctcaatagaccgcccccccaccgtccaccccaacaaccaaaagaaagatcggaatctggattacattttaacattatagactgacattggtgcaatattattgcggatgaattttcagtttatggatatatatataattcttcaatagctatggaatccagtcgagtggtgatacaaggcttcaggaatctgtatgttttctatctgacggattgctggaggcaagcagtatatatgatgtggatcaatattagcgacagctagcatgaattttaatgagttcctgatggtctctgatcggttcatccagagggatctctgtaagtctttctgtgtgtagtaagtaatcctactactagctgcagtgatttttttttaatttctaatttccaagtttgtttactgatatataaaaaaaaaa

SEQ ID NO: 1956 - DNA, 2602 bp, Pinus radiata
gcctttctctgcacaggccttttgtataccgcgtatcgagatgtaaaaatcttgtgacggcagcaaatgtgtgcatatcgttcgtatccttgagcaacacaggtcaagcttttattttcatgctcgagatatgggacaatagcagaagaaaacagattcctgccattctgtttgtcttgacacccgtattagatttaactaatactgatatctctggactcacatttcatctcgtcccatctcctgctcttatccgttctccctgtttgggcttctttaagtagtcggcagtaatggcggatggtagacggtgatcagtataggggctgactgacgcgggttcttgtagggtcgtagaaatgcagtcaggcgggcagtatggcattcacgacatccagcagcttatgatggagagaggtccgcctccgcgaatgtttgctctttcgccagatatgctgccacaccccatgaagccccccggcttgcatcctcatttaactcctcaccatttcatgcctttccctctggatcaccacttccagcactcgttggccactcatcatgcacagcagcaggcgatgcaagagcagataggtctgggcgacgattcttctgaaaatcaatcgtcgtttgcaaataggacagcaatccaagctgaaacagaggatgatgatgatggaatcgaaggtgaagacgatgaggacaatggtgatggatgggcaacagaagaaatcctgaaccttctcagaatcagttccgaaatgcatctcaaattccgggatccaaatctccaagccgtagcctgggaagatgtttcaagaaagcttgcagaactgggatatcacagaagtgcaaaagcgtgcaaggaaaagattgagcaggtgaacctaacatccgagaaagctaaagacggaaagagctttatgcagtttggcgagcttgaagctgtttataatggtggaagccgggtgaataatggcggggtcactaatgctgctttgcaggaagaagtagttgcaaaatctgagcaacaaaacaagaaaaagagaaaaaggaagcacctgacttcgatcaaaatattcttggagaacctggtaaagcagctgttggaaaaccaggaggccttgcatattaagtttctggaggccatagaacgccgagatcaagaaaggataatgagggaagaggcctggaaacgccaagaaatggcgcgtttaacaagggaaacggaattgcgggctcaggagcacgctcttgcctcgacgcgagaggccgccattgttgcgtttttgcagaaaattaccggtgaagacttgaagctccctgaagcgccggtgccatttcacgctacagaaactcaggaagatcaccaggcagcttgtatggataaagacctttccgatcccaacgggaagagatggcctaagcctgaagtccaagctttgattcgcttacgcagtaatttggagccaaaatttcaagagccggggccgaaagggccgctttggcaggagatatcagccggaatggcgtctctaggtttcaccaaccgcagtgccaagagatgcaaggaaaaatgggagaacatcaataaatatttcagaaaaaccaaagatagcatgaagaagagacccgaaaatgccaaaacttgtccatattttcaacagttggatgttctttatcgtaaaggaattctttcctccccaaacaagtgcaacagagtcgatcagcacagtaattcctcggatgcaatactagaagatcagggccacggtcatgagagtaatcacaaagacgaccttcgtgaacatattcaggtttcccgctcagactccgagcatataatgtctgtaatgcctgcagaggccgaagaaatcaccccggcaaataacaacgataacgtttatttctttcggagtcctgatcccgttgatcatggacaccaaatgacaaaattgaagcaaaatctgccggaaaataatcgcaacacttcaaattcttcgagtccaaacgtcgaatctggtacgacaacaagaaatgtgggaatatttccgaccgataacaacaaaacagcttcgaagatggaaagaatggcgaaagatatgttggaagcgcaacagcagcagcaaaagaaattcttagaagagttcgaaaggcaggaacacaaccagaatcagcatcttcatcaagagattagagaccaggagtttcgcggtcaacaaaatgaactgaaattaatacaagaacgctcgcattccgcaacgcagtctgcactaatggctttagtcgacaaactgactgcagaaatcggtggcgatttttccatccctctaccttcggccaaacgatgagcatacgagaattcaggtaccttaatcccaggatcaggtgaatatatatatctatatatgtgcattggccttgaatttaagcaagcatttagacttttctatattgtaagaaaacgaacagcaatctttatgtatgatagaactgttgatattatttgtgttttaaagactgaagcgttattaacggatttttaaagcagcattggtcagtattttctataatataaacttctttctcgttaaaaaaaaaa

SEQ ID NO: 1957 - DNA, 1386 bp, Pinus radiata; identical to SEQ ID NO: 793

SEQ ID NO: 1958 - DNA, 1880 bp, Pinus radiata
ccttcatggggagacgagatctatctaccgccccctttgtattcatggtctcgggaaacataacaagccctggtcggatcagagaggctcagacaaagatagcgggaatgaattaggccgcactaatttgaatcccggccaaataccgcggcggaggacgaggacgaccacactccggcctaaattcgccgccttttttataattaaaaacataaaaaggccgacgccatgaacgaaccagacgagcacgccgctgctcagctcgtgcagaagcgtagccacccgctggcggaggtggttatgcccatctccgtccgtccgctggcggagaaatgcggcgtggaggcggaggaggagaggaagcgggcggcggagcacaagaagcagcggtccaagaactggacgcgagcggagacgctgaaactcatccgcctgcgagcggaaatggagccgcggttcgcgcgcagcgggcggaagtcggagctgtgggaggagatcgctgaagcgctccgccgagagagcgtggtccgagacgcgcagcgttgcagagacaagtgggagaaattgacggcgagctataaggaagtccgcgacgggcagcgcgacaggcaggacttcccgttctttgacgagctggacccgctgctatctctcaagcctcagaaggcggcggcagcggccgccgctgccgctaccgccgccacggcggcgaattttgtttccgccgagactcccagcaattttccgactgacgacgagatgacggaagaagggtcccctgctgggaagcggagaaaaacgactccaagaggcctctcggcgacggacctggacgctgttcgtgagctcctggaaagcctggtgagtcggcagcagaggtttttcgtggatctgctggattccatggagcggaaagaggaaatccgcgagcggattcgtcaagaaaaggaggaaaagtggcgggctgaggaaagagcgcagcggtgtttatttaataacacaatgattattttagccaagaagctcgtcgatggcgactcagggttttgcgctcgcgacccagggttttgcggggctgaagaatttaaacccaaaccagccaccgggggttctgaccagactgatcacgacggtggcgtaattgttcccaatgttggcggcggtggcggagggccaaagaagaggtcaaagaattggaagcgagcggaggttctacggttaattaagtttagggctgagatggagtcgagatttgccaagtccgctcggcgggcggcgctgtgggaagagcttgctgagcttttgggggcggagggtattaagcgggatgggaagcagtgcagagagaaatgggacaagcttatggcagagttcaaagatgtgagcgatggcaagagggaccggagcgagagcccttattacgcagaactcaccgctaccgttggcactggtcgctctgctgaagcagggtgaaatttctaggattaagcgtggggtgaagctctgcaacttctctattggcctaagtaaattctaatataatttctttctgtcagatcatgtatcaaaaaggccaggccaggccaggctatttaaagactagttggtagttaagctactgctttgtacatatagatgaatgatttgcttctgttacatatgaaggaatgatttgctgttatcttcaaaaggaggatttaggtcatcaaggtatgtagttcaaggcagtgttctggcggctatggggcttctgtgtatgctgccttcagtgcctgtgaagccagctgctgtgtattttatctggcctgttcagaaacttccagaagttgaatatagcaatttaccatcaagaaatttagcttgttctgccaaaaaaaaaa

SEQ ID NO: 1959 - DNA, 2252 bp, Pinus radiata
ctcgtgttcagaacatattccaggtttcgccttcttctgatcatcaacaacaacagtattcttctcaaactcagcaacaccaacaacatcatgtttccaaaaatcatcaaccacaacaacaacagcagctgctgagacagcaagaacatcggaaggatcagatggttgctgctgctgagaaggtgggagaaggcagtgcatacaattctccctgcaaacaccttgaaccatctcccactcctgcccaccaagctgcccaagctggaaatattagtactgataaggcttccagcagtggggtagcagctgggggagatgatgatgtgtttggggttggggaggattgtgaaagactagcagggggaggaggaggatctgcagggaatcgatggccccgagaagagactctcgctcttctcaagattcgatctgaaatggatgccaatttccgagacgcgaacctcaaggggcctctctgggagcatgtgtcacggaaactggaggagcaaggctatcacagggatcccaaaaaatgcaaagaaaaatttgagaacattcacaaatactacaagagatccaaagaaggaagggttggacgacaggatggaaaaaactatagatttttcagccagctagaagctctgtactcgaacaataataacaaacctcctcagatcagcaacaaagctgtgaatgacgctagcaccatacccaacggaggtgatagagtccaggcacatgcagatcctacgagtactagacaagatgaagaccataataatttaggaggcaatttcatggtgggtacaacaagtgcaggaaatacagatcttaattccagtgagggcatcagtttttcttcagactcatcagaggattacgatcagccaagggacagtaataacaagaaaaggaaacgaagtggcaccaaaaaactgatggccttttttgagaacctcatgaaacaaatgatggagaaacaggagaagatgcagcagacgtttctggaagccctagaaaagagagaagaggatagaatgatgagggaagaggcctggaaaaggcaggaaatggcgagattgaacaaggatcaagaattaaggtctcaggaacgttctatggctgcttcaagggatttggcattagtgtcatttctccaaaaattcacaggtcaaacactgcagcttgatactcaattaatggattcttctcagatccatagccaaggtgatcaagaacaagagcaggagcaagatcttcatgatgaacagtacaaggacttgaattgcactgatcctaacagcaagagatggcctaagcctgaagtccttgcactgataaaagtcaggagtggaatgggttctagattccaagaaactggccccaaaggacctctatgggaagagatctcttcacaaatgtcagctcttgggtacagtcgtagttccaagaggtgcaaagagaagtgggagaacatcaacaagtattacaaaaagaccaaggagagcaataagaagaggcctgagaattccaagacatgcccttatttttatcagttggatgccttgtacaggaggggtatgatgtccaatccccataagatgaatcagatgcatgacgaggatcttcgacccgacgatgaggatcaccaggatgagctcctagagcaagtcagtggaagcaatattagagatgacagtggacatggccaaggcgcagatggaactggggatggggaaattttgcctgtcaggccactcccactcccacgcccacactcagacagtattgctccacctcaaactccaaccagtaatgcaacagtgacattattttctactccagagaaccggaatgctgataacggatccttaccaaaggcctcgtaattctgacactgcagacatacaatttttcaggattctgtgaagcgagaaggtttgttgatgaaggagatactgggtcacatgcaaacaaccccaaccccacagcatgatcctccatcagccctagaaactggtagttctggtcataataacattaagaagaaggtgggactggtccattctgttatgaataatttacaggagcagggaaagaaaaagcagaagcaggcagatctccactattctgcaagtacaagagatgctaattcctttatggaaatggttcaaaagctaacggcggccgacactctagacttcaacttgtctgcatcatctcaatagaaaaaacaaaacccaaaaaaaaaa

SEQ ID NO: 1960 - DNA, 1300 bp, Pinus radiata
actagtgattcgactggagcacgaggacactgacatggactgaaggagtagaaaaaattcgtcatggatgacacagacgatgatgcccgctatccgcccaatgcttatgcactgcaataccaccagtcgcataccagcaatcccttccatcgcccaaagctaccattgaggccggcgccccacgaacataccgctgcgtttgaagacgaagaagaagacgaggaggaagaagaggagaaggacgaggaagaggaggggaattacggggacgacgaagcagatgagtcagagaaccatccagaagcccaggagtctggcacgcgaggcaagaacatacagaagacacccgacaagccaggtgtcgacaggttcggacttcgaaactcgtccccaaatttatgccccaagagcaacccggaatataatttgggtaggcctgaagcaaagggctccagggatgattggtcggaagctgctacttggatattgctggagacatggggggagaaatatttgcaggcgggcaagaagagcttgaagctggaacagtggtttgaggttgcaaagaccgtttcggctgcttcaaaggttttcaagaccgatatacagtgcaggaacaggttggacacattgaagaagaagtacaagaaggagagacaaaggagccctgatagcaagtgggtctattacaaatacatggatgcactgctcaattcttctccctggcagactgggctgccctatggcatggatgctggggaatttgtgtctcaagtgcccttgagacctaggatttgtttgaataactccaggtttgaggaggttagggatggccccggggattcgcccagcgaagaggaggtggaggaagacgaagacgaagaggaagaggaagaggaggatgaggatgatggagggaggacgttgaagcggcgaaaggaggacgaggattcgttcaggattttggctgattccattcatagatttggggagatttatgagagaattgaaaatagtaagaaacggcagatgctggatttggagaagatgaggatggaatctgacagggatttggagatgcagaagagacggattttggagcagacccagatcgagttagcgaaaattaagcaggggagtgatgacattgatgcttccgtcactaatatgagtggctgaggacgtgggcgacaataaggatggagttatgtttgagatctgaacttagccacatcaaaatcacaattattaacattggtaaatacttccactggctaggcttttttctttcccctttact

SEQ ID NO: 1961 - DNA, 2486 bp, Pinus radiata
gacgtctctcaattcatggtgggaaggggtccctcaactcgtgttcagaacatattccaggtttcgccttcttctgatcatcaacaacaacagtattcttctcaaactcagcaacaccaacaacatcatgtttccaaaaatcatcaaccacaacaacaacagcagctgctgagacagcaagaacatcggaaggatcagatggttgctgctgctgagaaggtgggagaaggcagtgcatacaattctccctgcaaacaccttgaaccatctcccactcctgcccaccaagctgcccaagctggcaatattagtactgataaggcttccagtggggtagcagctgggggagatgatgatgtgtttggggttggggaggattgtgaaagactagcagggggaggaggaggatctgcagggaatcgatggccccgagaagagactctcgctcttctcaagattcgatctgaaatggatgccaatttccgagacgctaacctcaaggggcctctctgggagcatgtgtcacggaaactggaggagcaaggctatcacagggatcccaaaaaatacaaagaaaaatttgagaacattcacaaatactacaagagatccaaagaaggaagggttggacgacaggatggaaaaaactatagatttttcagccagctagaagctctgtactcgaacaataataacaaacctcctcagatcagcaacaaagctgtgaatgacgctagcaccatacccaacggaggtgatagagtccaggaacatgcagatcctacgagtactagacaagatgaagaccataataatttaggaggcaatttcatggtgggtacaacaagtgcaggaaatacagatcttaattccagtgagggcatcagtttttcttcagactcatcagaggattacgatcagccaagggacagtaataacaagaaaaggaaacgaagtggcaccaaaaaactgatggccttttttgagaacctcatgaaacaaatgatggagaaacaggagaagatgcagcagacgtttctggaagccctagaaaagagagaagaggatagaatgatgagggaagaggcctggaaaaggcaggaaatggcgagattgaacaaggatcaagaattaaggtctcaggaacgttctatggctgcttcaagggatttggcattagtgtcatttctccaaaaattcacaggtcaaacactgcagcttgatactcaattaatggattcttctcagatccatagccaaggtgatcaagaacaagagcaggagcaagatcttcatgatgaacagtacaaggacttgaattgcactgatcctaacagcaagagatggcctaagcctgaagtccttgcactgataaaagtcaggagtggaatgggttctagattccaagaaactggccccaaaggacctctatgggaagagatctcttcacaaatgtcagctcttgggtacagtcgtagttccaagaggtgcaaagagaagtgggagaacatcaacaagtattacaaaaagaccaaggagagcaataagaagaggcctgagaattccaagacatgcccttatttttatcagttggatgccttgtacaggaggggtatgatgtccaatccccataagatgaatcagatgcatgacgaggatcttcgacctgacgatgaggatcaccaggatgagctcctagagcaagtcagtggaagcaatattagagatgacagtggacatggccaaggcgcagatggaactggggatggggaaattttgcctgtcaggccactcccactcccacgcccacactcagacagtattgctccacctcaaactccaaccagtaatgcaacagtgacattattttctactccagagaaccggaatgctgataacggatccttaccaaaggattctgtgaagcgagaaggtttgttgatgaaggagatactgggtcacatgcaaacaaccccaaccccacagcatgatcctccatcagccctagaaactggtagttctggtcataataacattaagaagaaggtgggactggtccattctgttatgaataatttacaggagcagggcaagaaaaagcagaagcaggcagatctccactattctgcaagtacaagagatgctaattcctttatggaaatggttcaaaagctaacggcagccgacaccctagacttcaacttgtctgcatcatctcaatagaaaaaacaaaacccaaaaaataaaatcttattctattagtaaagtagccattaaaggcaatcggaagcaggaagcaggttataaattgattgagagtatcttctgtaatatatgttactgtaccaatagtaggatagtatgagcatgatgtatggtatggtgtattattgttagggcagatgtatgaaataaatatatcagagaatgtgattggttggagtttgtgtaataataattggtattttatttatttaaaaaaaaaa

SEQ ID NO: 1962 - DNA, 2659 bp, Pinus radiata
gggggaggatgaaggagaagggagaaggtagtgaaattattcaagctggtagaccccagcagtttggtttgccgcagcaccagtccgactcgatgcttcctcaatttctcgcttctctgactaaagaatctcctcatttccagacttcgcaaacatatgagaatgagtcccagcagtccagggatcaaaccccgctccaaccgaccaccgcagacaccaagccgaaggacattggtgaattttcgtcggatttaccccacctggtagcctcgcctatttccagcaggccgcctgcggtgactggaaccgatgtcgtttttaaacaggcgatacacggccccgacgagaacaacaacaacaataacgcggcggaccttggagacgatgacgcttttggcggatccggagggagccgatggccgaggcaagaaaccctcgcccttctcaaaattcgatcagaaatggacgccgctttccgcgatgcatccctcaaggctcctctctgggacgaagtttcaaggaagctcgcggagttagggtttcatagaagtgcaaaaaaatgcaaagaaaaattcgaaaatgtgaacaagtattacaagaggactaaggcgggaaggtccggccgacaagacgggaaaacctataagttcttcaaccagctggaggccttatatggcaacaccgacgacaccgccattgtggacaacaatacaagcagaatcaccaatatcatggccgcttctgtatccagtcgccgagttcaagctacgcccagtcctcctcctcgtcctggctggctggttactacgaatagatcagaagagacgcaagtcccggagagaagaacctcctgctcctacagatttgagtccgatgagttttcgactgagtcatcggatgagacgcatgatgataataatatttcagagactcggagcagcagaaaaaggaagcggattaccaccaagaaaatgatgagatttgtcgagaaactgatggaaagagtcatggagaagcaagaaatgatgcagcagagatttcttgaaatgatcgataagcgcgagcaggataggatgatccgtgaagaagcttggaggcggcaagaaaatgtcaggttgagtagagaaagcgaactgaggtcgcaggaacgagctctcaccgcatcaagagatagagcactaattgcctttctccaaaaagttacaggtcagacactgcatcttcctgatcagtttcctgttaattcgcagcctctctccccagcgctgcctcagcaaattcatccgcggcccgaggagataaataaagataataatgatactgacagcttggatccaaacagcaagcggtggcctaagcaggaagttcatggactaatcaaactgaggagcgcactggaacctaagtttcacgattctggacctaaagctcagctgtgggaccaaatttcggcagaaatggcagctatgggatatcatcgcagcgccaaaagatgcaaggaaaagtgggaaaatatcaataagtatttcagaaaggccaaagaaagtaacagagaacgccccgggaataacaatacttgtccatatttccaccaattggacgcgctctacacgaaggggattctcagatattctaattcagaaaagttcaacaggactcgagaccaggaccagcagcaagaggagcttcttgagcaaaccacctgcggaagtagcagagacgatcagagtccgggccacgacggtgacaatgaaatcctggccatcatgccaccaccatccatcactaccgctccgcctgcatctaatttcttctctacagatcaaccagacggtcacgtcaatggcagccaagctccggctccaatgaaggtaatgttttcttcagtttcggaaggattattaggaaatagccctcccaagccagatgcaacgacaatcatgatgtttcaaaacagctcgcaatcagctccaccgctctccacaaccataacagttgaagatgataagaacaagcacgagaaacaggcagatctggatttaccttatggtgtctttaatgacaggacggttaactccgcctccaatgtatccagagattcctcttcgacattcatggcaatggtcgtggatccgccacagttcaacattcctggatcatcccacgccgactaaatctatttaaatgatttgtcgatgaatgaaatgtttgtattgaggttttcctgtaccatatgtatcagtaatcgcacggggccactagcggaactgaaccagcaggtttatcctgattatagacggacatttgttaggtcgcagtaataatggctatatgcaataagccatctcatatcatgctttattattgttggtgtctgtcaggtccttgttttgtgtctgagagtgatagaacagattaaattaggaaacctggcccttcagtcctgcgctggactcttgtttatcaggccaggctacctctagtttgtttgtggttttatgtttaaatcttagattctgagattagaggttatctatatgattgaccttcaggcgtgggagagagaccggattaagggtttccttcagatatgcctgtttgtatttgtcgatgcaggaaattgattggttatttttattgccagaattcaaaaaaaaaa

SEQ ID NO: 1963 - DNA, 2346 bp, Pinus radiata
attttcaactaaaataatcaaaataaaacgggtgaagaggtcccgtgacgccatgcctcataaccgtcaaattggaagcctccttgctatggtttgtcatagctgaaaatttaaaatttcattttgacaaacgccacaagacttttgacctctgcatttgctggcttgtctccactattcacagtcagtcagtcgactattctacggacgaggagcgggagaagagggagcaggtgctgtattgccgctgcctgtttcccccctttgtgttctgctctgctgggtaagaggtaagtaagtggtgggatccgaatgctatttttatatatgtttgatcaaacccagaaggaggagaaaacagaaaccaacacaaataatgtactctacacagtcaccattttcatctctaactcatccttccatttcatctcagtcatttcacatacccatttcgtcatctcctcagacgccgttgcaccaccatcacctccacatacccatctcccattcccagccttcactatcacaccctaacgcgttgacatttcagccagcattgtaccattcgcccgaggttcaaataccccagctgcaccaggtctctgaaatttgcgagccttgttctatctcgcagcctctctgtgacatccccagtctctgtgaccaagtgcaagtgcagtcagttcaatatgccatttctgaggcggtctcccacccagactccacttattccactcagaattcttctaaccccgacgtcaagggtctggagaatgacaggttagaaatcgtaaaggtagaagaggagggagatggggatgattacaaaaagaaggagaaggagaaggagcacaagaaaaggtctaagaattggactaggtccgagacactgaaattgatcaggctgaggactgaattggagcctaggtttgccaaagggggcaggaaatcggagctttgggatgaaattgcggaagccttgcagaatgatcagatttctcgtgatgcacagcaatgcagggataagtgggagaaacttgcagctggatataagggtgttagagatggtatcagggatagagaagataacccctttttcgaagagcttcatactttgctgtctggaaaggggtcaaggagggataggggggataaggatcatcacgatgtgcaggaagtggagttgcctaaaggactactttgcgacactggtcgagactcagtcatcagcgagacagaaatcaatactgataagagaagttgtgattttagggatgaggaagaatgggaagtcgaaataatggcctcgaagggaaagaagaggagaagaccgagatacgtttcggtatctgatttgtcggccgtgaaggatttgattgagacggttattgagaaacaacaggagtttttcaaagacctccttgagactgtagagaggaaagaacaaatgagggagcaagcacggcaggagaaagaggagaaatggagagcagaagagcgtgctgaaagagacatgtttaacaatgctatgatgacattgacacagaaacttgtgggcgagggagtggggaagtttacggcaggagctcctgtctttcaaactttaatggatgggaatcaagcattgaagaaacgctctaggaattggaagcgggctgaggtgcttcagttgatcaagattaggggagaaatggatagcagatttttggagtcaacaagaagggggcttctgtgggatgaactagcagaacgtttagtggcacaggggattaaacgtgatgcaaagcagtgcagagagaaatgggacaagctgatggctggatacaaagatgttgttgacgacaagaaggacgctaatttgagtccatattatgcagaactcacagccatgctagggcgggaaaatgccaacttacaataggtgccatctatgaaaattaacattgttcttgcatcaggtaggaccttaacagggtgcaaatgcttctgtgggcctttgctgattatggtggttctgctttatttctggataaacattgaatgccattttcattgtattagaagtaaactggaaagtcatccttaggtggcttgtttccatttttagggacaattttacttttgaaatggatcccttgtgcatcatttttgctattaatgcaaattgtagcagtggtcccctacagacacctggaagagatgcagcaaatggatatcaagatctggacagtttaaacatgttcccttctcgtcctgagcgatattttgtatcattattatctggatgtacagtaaacatgatgtttctttttcggaaagtggcatttcagttggtcaaaaaaaaaa

SEQ ID NO: 1964 - DNA, 1911 bp, Pinus radiata
ggaaattctagttttgtatttatgctccaaatatatgctattagaattttaagctgagagggactcttagtagtgtcccaggggaacactattattggcaggaaaacatacagcaaatacgcctgataacagtggctgagtatttggtctggaaggaaagcttttaaggcaagagattacagaactatcgagatgtctctgagaagcataatgcgtgagattaaggaagtgcgaaatggaattggtaacatctctaggagacgaagttttgacatgagggtttcacacaaccacagggcaagatctcaggcaaccatagatgatactctgagtcgagttctctttgtccaacagagtcaatgggccaatcttccaccagaattacttcataatgtgattcagcgcttggaagctagtgaaggtacctggccggctcgaaaaaatgtagttgcctgcgctggcgtctgcaagtcttggcgtgagataactaaagaagttgtcaaaacaccggagcaatgtggaaagcttacatttccaatatcgttgaaacagcctggaccacgtgatccacccatgcaatgttttatcaaacgagatcggtcagcttctacatacaaattgttcctgggcctaactcctgctttgcttgttgaaaatgggaaattcctctttgctgccaaaaaagttagacatgccacaagcacagattatataatttctttgagttccgaggacttctcccgagcaagtaacacatatgtgggaaaattgaggtcaaacttcttgggtaccaagttcacaatatatgatagccaacctccgcacagtggtgcagtagtcttaactagccggccaagtcggagattttattccaagcaagtgtctccaagagtacccgctggcagctataacatagcaaacattgtttatgaacttaatgtccttggtactagagggccaaggaggatgcagtgcacaatgcattctattccagcttcttctattcaggttggaggaaatgctccaacaccgacagaatttcctcgttcattggatgaatcattttccttacccttttccaaagaaccccttatagatttcagcagctctagcttatcagaaattccaatcaatgttgagagcaaagatgtaccgcttgtattgaaaaataaggcaccgagatggcatgagcagttgcagtgttggtgcctgaatttcaagggacgtgtgacagtggcatctgtaaaaaactttcagctagttgcttccgtggaaccttcgcagttggtgacacaagctgaccaggacaaagttatccttcagtttgggaagattggaaaagacatatttaccatggactatcgctacccgctgtctgcttttcaggcctttgctatatgcttaagcagttttgacacaaaattggcctgcgaatgagagcaatgaccttggtccattgaagttgctcattccgtacaaaattaggatatccaggtgcagtattataagaccaattaatccgcagaatacaccaccagatacttatgtaacatgttcacaacgatgaagaggattttagggggtgataaaatcctcagtttttgcacatgggtatgtgtagcattttggaatcagtttcataggaaaacaacatgttaatgcaatattgcagattattgtcagggatcttccatgttttataacacactagttggcctatttgtgtttctctcttttgagaaatagagacacgaaactagtggctatcatgcctatgtaacttgagagttctataacacactagttggcctatttgtgtttctctcttttgagaaatagagacacgcaactagtggctatcatgcctatgtaacttgagaaatttatattctcgtaaagcaattggaacca

SEQ ID NO: 1965 - DNA, 1941 bp, Pinus radiata
gttctgcatggaaattctagttttgtatttatgctccaaatatatgctattagaattttaagctgagagggactcttagtagtgtcccaggggaacactattattggcaggaaaacatacagcaaatacgcctgataacagtggctgagtatttggtctggaaggaaagcttttaaggcaagagattacagaactatcgagatgtctctgagaagcataatgcgtgagattaaggaagtgcgaaatggaattggtaacatctctaggagacgaagttttgacatgagggtttcacacaaccacagggcaagatctcaggcaaccatagatgatactctgagtcgagttctctttgtccaacagagtcaatgggccaatcttccaccagaattacttcataatgtgattcagcgcttggaagctagtgaaggtacctggccggctcgaaaaaatgtagttgcctgcgctggcgtctgcaagtcttggcgtgagataactaaagaagttgtcaaaacaccggagcaatgtggaaagcttacatttccaatatcgttgaaacagcctggaccacgtgatccacccatgcaatgttttatcaaacgagatcggtcagcttctacatacaaattgttcctgggcctaactcctgctttgcttgttgaaaatgggaaattcctctttgctgccaaaaaagttagacatgccacaagcacagattatataatttctttgagttccgaggacttctcccgagcaagtaacacatatgtgggaaaattgaggtcaaacttcttgggtaccaagttcacaatatatgatagccaacctccgcacagtggtgcagtagtcttaactagccggccaagtcggagattttattccaagcaagtgtctccaagagtacccgctggcagctataacatagcaaacattgtttatgaacttaatgtccttggtactagagggccaaggaggatgcagtgcacaatgcattctattccagcttcttctattcaggttggaggaaatgctccaacaccgacagaatttcctcgttcattggatgaatcattttccttacccttttccaaagaaccccttatagatttcagcagctctagcttatcagaaattccaatcaatgttgagagcaaagatgtaccgcttgtattgaaaaataaggcaccgagatggcatgagcagttgcagtgttggtgcctgaatttcaagggacgtgtgacagtggcatctgtaaaaaactttcagctagttgcttccgtggaaccttcgcagttggtgacacaagctgaccaggacaaagttatccttcagtttgggaagattggaaaagacatatttaccatggactatcgctacccgctgtctgcttttcaggcctttgctatatgcttaagcagttttgacacaaaattggcctgcgaatgagagcaatgaccttggtccattgaagttgctcattccgtacaaaattaggatatccaggtgcagtattataagaccaattaatccgcagaatacaccaccagatacttatgtaacatgttcacaacgatgaagaggattttagggggtgataaaatcctcagtttttgcacatgggtatgtgtagcattttggaatcagtttcataggaaaacaacatgttaatgcaatattgcagattattgtcagggatcttccatgttttataacacactagttggcctatttgtgtttctctcttttgagaaatagagacacgaaactagtggctatcatgcctatgtaacttgagagttctataacacactagttggcctatttgtgtttctctcttttgagaaatagagacacgcaactagtggctatcatgcctatgtaacttgagaaatttatattctcgtaaagcaatttggaaccagtttcgtgggaaaaaaaaaa

SEQ ID NO: 1966 - DNA, 3280 bp, Pinus radiata
agcagtttctcatctttattcacacacgccgggagcatgggttcgatggatagacattgtatataccaccgtgaacagattggaagttttgcgattttcaggggactctgttgagcatatagacagaaaaagcctctatatatacatttgatcgaaatcttttacgggttccgattctcaaaagagtgattggtatgcgaaactcctgcgaaatctatggcggggaacgaagaaaataacaagatggggtttctagattggggtcccttaactagcccaacaacgcttattgcctctatgatggcggaggacttcagttcccggtccttctctcagcttctcgcagcaccgcagatcgaaaccccgcagtcccaagagcaaaacctgaagccgttatcacctgcgggctttaatggcagcagcagcaggagcggtaaagagaatgatccttttagtatttcaggcggttttgcggccggatcggtgccgacgagcggttttgggcaggtccataaaccgccttcgaggaccggtggtggtagttttgcggagagattggctgcccgagggggattcaatgcacccagattgaatacagcccggtttaagtgcttgccttctgtttcttcacctggtggggtgagatctccttatttgaccatcccccccggcctcagccctactaccttgctggattcccctgttctgctctccaactctcaggcagcacagtctccaacaacaggctcattccctctgccgccttttttgcatgaaagttctttatctcctccagtaaattctggctccgatggtttaaaggataagagttatgaggatggtacctcgtcctcattcattttcaagcctcatgtgaaatctggcccttcttcttgcttgtcacctctaggaggcctggctacttttggctccagtcaacagcaagctgtaggtggattccaggttcagacagagtctcagacttggcctcaatttgattctcagatgcctagtcggtccaattcacaaggacaggcccaaatgtacacccaaattcaaactcaagcccatgctcaatctcatactcaagctcaaaatcggactgatgcccaagtcttcatgcaggctggaaataaggctcgttctcatgctgctgcccaagtcaaaactcaggcacaggatcagggtcaagctcatgttccagcccaaggtcaggcacagctttgggagcaggctgtagcaaactctactggaacaaaagaccttgtggcatattctctgcctgaatcaccagtgcctaacaatgttatcgaagaggcaaaatgtgttcctcctttacaagttgcccctcctttacatgttgatcctcaagattttccttcagaagagtctgttccttcagaggagcaagaacaaatgcacgattcagatgctcaactacagcttccagaaggggaccaaaagggcttagctcctcataccatctcagggagaccatctgaggatggtttcaattggagaaagtatgggcaaaagcaggtgaaaggtagtgagtatcctcgaagttactataagtgtacacaccccaattgtcaagtgaagaagaaggttgaacgttctcctcatggacaagtaacagagattgtctacaaaggtggccataatcatcctaaaccccaacctagccgtcggtctgcagttggatctgctcatatgattcaggaaggggcagaaagtactgaagctactaccaaagttgaaggtgggaatacatggagaaacacagaacttggtctcttgaaagataaagatgctgcaaattgctctaagacatggaagaatgaacttttggagaggtcctcatcagcttctgttgtaactgacctttcagatccatcatcaacagcccaagttcaaagctccagccgcctagattcactaggtactccagagatgtcatcaactatagcaagtgatgatgatatggaagatgcaaatgatagcaaatcagtgggagatgatggtgatgaaaatgaatctgattcaaaacgcaggaagaaggaaaacaatacagtcgacattgttgcagcatctagagctattcgtgaaccacgtgtagtggtacaaacaaccagtgaaattgacatccttgatgatggatatcgatggcgcaagtatgggcagaaggtggtgaaaggaaatccaaatccaaggagttactataaatgcacaaatgctggatgtccagtgaggaaacatgtggaaagagcatcacatgatccaaaagcggtgatcacaacatatgaaggaaagcataaccatgatgtgcctgctgccagaaacagcagccatgataatgctgcaaaagggaatggggcagctcctctagcaatgcagaataatgtcccagcgcctatgaatgctataccacgacctgttccccaagttcaggacattgtttctcggcctgttcctcaagttcaaggcattgtttcccggtttgatagacacttggatcctaggaatgaatatgtaaaacgtgcatattatgaaaaggttgtagatgagaacctacatttgcaagataagaatggtgggagtcttgacttgaaaatgggggcagggatgggttttgggatgtttggtttagctaataatcatactgataaaaggcaaattgcagaagggcatccaccatttccaatgcagatacatagcactacaagccatgggttacctggcatccaatttagtggaaagcctaccgttcccgttcagtcatattttggtcaagctaaagataatggcatgagattcctgaggccaaaagaagaacaaaatgacgattctggttttgggaacacattaactttcaatcccacgccaaacccatcattgtatcaacaaatcatggggaaactatcaatgggaccctcattgtgaattcttgtttagtcacaccagcttgcttgagaatacggtaatttttttgagcatgaaatgtgttttatgcagagtatcacaaagcatttgtgatcattctacatatttgaaaataagaaaagcatttatccttgaatgccatgaaatatgtggccctgaacagattttcaagtcttgtccatgtaacatcctcagaaatatgttataggttgtggtactgttaactatttcgcaggtcctgtattaagaaatgatttccatgtaaattatacttcaaactagtaacattgggtcttcaattcttcagtccttttcgagtctttggttaaaaaaaaaa

SEQ ID NO: 1967 - DNA, 1658 bp, Pinus radiata
atcgtaccggactcaagaacacaagcaaactcacggtagtttccctccagctcctggctggaacacgacttctaatcagctttcttgcgacgccaggtctcaagatcgaaacctgtaccagaccttcactactcctggagccagcggattcggattcaacccctccgcagaaatgtcgtggaatctcgacatacatcatcatcgtccttctcaggctctgtccagaagcagcgcattgatggacattgatagcgggcttggcggagatttccctcttatcagcttccaagaatttttgcagagagatgaagaatttcacgactttggtactcatgttgggaggcccctatctcaaatcccggaagaccagcagacacggcacgaggctccagaagaagcagcagattttcttcactccggtactcccgtggcggccaccgaagaaacccgcgctggaggccgctcaggcgaaacttccaccgtcccaggtactcccaactcatcactatcttcttcctccagcgaaggccatgaagaatccagtgcagggatcagattagggccttcaaagacggagcagccctctgaagatatcatcagtacagaaagcagcaagcctacagaaccagaagctaagaagcagagcagacctaggaaaaagggccagaaacggaaccgcgagcctagatttgctttcatgaccaaaagcgatatcgatcatcttgaagatggctatcgctggcgcaaatatggccaaaaagcagtcaagaatagcccctttcccaggagttactaccgctgcacaaatggcaagtgcttcgtaaagaaacgagttgagagatcgtcagaagatcctagcgtagtgattacaacatacgaagggcagcacactcatcatagtcctgcactgttgcgtgggtcatcgtctggaacttcagatcaattaacccactttggaggagcagcagaccatcatcgcaccgcatccccttttaacactgctcagtcacccagcttcaatttacagagcctgagaatggcggtgcaggtccctcagcgcactaattattatggtatgggcagtttacaggcacatgatccaatacaccggggcagcagcaccttacagcaccaacaacaaattataagatcaattcagcagcagcagcaacaacaacagcatgatcattctcagcaccagcagcagcatcagctaattcattcccagcaaatgcaacccccatcggtcgaccagggtttgctggaggacattgttccaccaggcatgcgcaaaaatccctagcagcttatttctaaacatatatacatagttatatatacatacttatcctgtttcgaagaacatcaccattactgactgccacagttcatgttggacgtgccatatgatctgcaactccacgtgaggtacgcccagaaattttatccttaatgcccatgatgtttcttgaaaacaattttatggccagcagctggatcttcccctctccatgcatatattgcaaccagatcccgtggaatgtttgcagacttcttaacagctaggccaattctcagttcggtgaaacgatgataattccggtcttagttctttgttgcttatcgctcttaattaaattccttttagaaaaaaaaaa

SEQ ID NO: 1968 - DNA, 1679 bp, Pinus radiata
cttttgttgtttagctgattgtgtgtctgtgccattgacttgggctttgcagatgggtttgtgaatggggcattgggttttggttttacagagcagtatctgtttgtttcagagtatcagaaaagattgaggctggagtagcagaagtcgcagctatgagggagattaataatgttgaagaggctaatagagctgggttagacagcagctatagagtgctagcaattttagcacagcaacggcagcagcagcatcaagatcaaaggcacgatattattactgtgagtgatttggatatgactactaaggaagccatatcaaagtttcagaaggtggtatccttactgggagcaaggacaggtcatgcaaggttcagaaggggtcctcgccaatcccctgcctacacaaaagcatgcatggaatctccaagctattgtttcagtcaacatgtctctcctggattggtttctcccccagaactgagcccatcaccagcaccaatcagacaatttatgcccagtcagaattcagcaccaacagtttttggtatgaatgcccatcatcatcgccaacaacagctttaccaacagcagcaacagcagcagcaacagcagcagcagaagttacactactctcaattacaacagcagcagcagctcaactttcaagcagagctgatgttgagaaacaattccttcatgaaatttgaaaactccataagctgcacacccacgctttcatcaacaaaatcattcatgtcgtccttgagtatagatggcagtgtggcaaatgacaagccattgttaacctatcatcagctcatgaatcccgttcaggaggggggcacggtctcgtcttcgaagcgaaaatgttctggaaaaggcgatgaagcaggtggtaaatgcaggagcactggaaggtgtcattgctcgaaacgaaggaaactacgagtgaaaagatctattagagtaccggccattagtagcaagctggctgatattcctccagatgatttctcgtggaggaagtatggtcaaaaacccatcaaaggctcccctcatcccaggggttattataaatgtagcagtgtgagaggttgtcctgccaggaaacatgtggaacgctgcttggaagacccctcaatgctgatcgtgacttacgaaggagagcacaatcactctaggaaactctctggaagcccgaatcttgtggtgcacccttgaagtttcctgtgaattgttttgctctttttgatttgcaggttggctgatgggacagcaaatcgaaaaccttcttcacttggaaatgttttctctggtgttggcatattgcaaccttaaggccatgtgatcattttgctgcaaactgaaagaggcgggccctaggctttttcctttgtaattggatcctctagatggatgatagcattttttcttaactggcattcatgaatttcaagttatatatacaagtagctctgatggttaatcaggccttggtatgatgtctggttgagtttaagctcaatacctatggttgcaaccagtttgtttcagcaagaacaatatgagaggtgtgtacctcctagcaaatacagaacgggaaagaaatggtgtattgtcagtctactgaagaaaatttagttttatctccactgattggtggctgtaaaaaaaaaa

SEQ ID NO: 1969 - DNA, 2752 bp, Pinus radiata
cggcggctcaactatatcatcgctgtgtctttccatggagattccacaagcaaaaaccatcacaaattacagttagagaatggatacgcacacagattgacgacattaggcaatacatacccacaccgcctctttacatttaacaatactacttataattagtactggtatagattgtggtactatccccatttcctgtttttctacccacatggattatcagcaggaacagcatcctgtcacctcaagttcccatttttacttcccagatcaagatttggacatgaattccaaatccttttcggatcttctagctgataataatggagacagccttatttggggtgcgaatgagcagaaattggaatttggcgctgcagggggggtaaccagaggtgggaacagctttgccgaacgctttgctgcgaggggaggggagcccctgaagctgagcacagccaagtttaaaacgatgtcccccagctctcttcccatacccagatcgccctttctctcaattccccctggtttgagccctaccaccttgctggactctccggttttgctctccaccgcgcaggatatggaatcaccaacaacgggtacttttccattgcaatcgttttcatttcaaagcactgctgctactgcttctttagatattgtaaagaatgaggatggcagctgctctagctttgctttcaaacctcttgccggttccaaccctagttcggacatgcaacctttgggaaacctggcaacttttggttacaaccaccatcagtctctaaaaggggttcaggatgatgctcggatgtggacttcgccaatctttagccagacaaacgagacaaacgagactggggcaaattcttcatctgaaccaacaacgactggcactactgctatgcaagctgttcctcttcaggctgttcgttcacaggcagcttcttttgaggagcagcaacagaggccgctttcagactttaaccaaactgcaatagttccgcctactggaattgaaaggccttctgacgatggatacaactggcgcaaatatgggcaaaagcatgttaaaggtagtgagtttcctcggagttattacaagtgcacacaccctagttgtccaaccaaaaagaagattgaacgttctctggatggacatgtaacggagattgtgtacaagggtcttcataaccatactaaacctcagcccagtcgtcggatgggagctgcagcagctgctgctgctgcggccgctcgtcttgaagagggagaaagtactgaaggctctggtgctcttgtcaaagttgaagatccatcgtctactccaccgcgaaggcaaaactctaatcacctggagtcactaggtacaccggagcaatcaatttctgcaagtgaagaagatgatgcaagaacccaagtggacaagttctctggtgatgaagatcttgatgaagaagaatctgattcaaagcgcaggaagaaagaagttaatacgatggatatcataggggcaactagaactattagggagcctcgtgttgttgtacaaacaacaagtgatatcgatatccttgacgatgggtatcgctggcgcaagtatggacagaaagtagtaaaaggaaatcccaacccaaggagctactataaatgcacaaatgcaggatgttcagtgaggaagcatgttgaaagagcctcgcatgacccgaaggcagtaattacaacgtatgagggaaaacacaaccacgatgtcccagccccaagaaacagtagccataccaacgctggattagggagtggacaaccaccagtacctattttgcagaatagtgttgccccctccacaaatggaatggcattgactgctcctggaactcaagagacattctcacattttgataggcatcctgatcttcataatggctatgggaacaacaattacatgtttggaagaattgcaaatgagagttataattctcaaaatgggcgtggattggggatgagccttggggcatttggtctagagagtaagcactcggaaatacagcaagcagaagctcccacttcttttccaatgcagattaagcctgcaagccatgaatattctagtattggttcaggtaattctggtcacatatattacaaccagcctaatgagagagatggactaatcaggcctaaagaagaacaaaaggggcaatttcttgtttgatacttcacattgaattgtgcctctaatatatacaaagagagaagggactaacgtatgtatgtgcctaccattctgtattcttttcgacattggtgagtgtggctccaagcaacgtatttttgctgtcatttgacgttgttggaggattagtgccaggtggtgcagccttagagtataactgaacagttgactgtcctgaccaagtttaaatatcttctcaagcaagctctctggaatattcttggcttcaagttgacataacatgtacatgtgaaatttttgacatgttaatttgtggggccaagtgagtcatgttgttttggactgcatcttgccgagaccgtttacagctttaacttttgacccctcatctgaaaggatcagcaagtgaattgttatattgagccatgattattgtttatatattttttcaattcaatctctggagcttgtaaatagtttctagacatttatttattcctgactaatctatttcaattacattaccaaatatgttatcctttttcaaaaaaaaaa

SEQ ID NO: 1970 - DNA, 1749 bp, Pinus radiata
ccttgaaattagatgctccgacccccatgaacaagatccagcaggcatgcacgaatcatgatgcggccctctggacaatcaagattcatgcagcgccctcgttttaaggaccaaacgcggcgctgaaaacggaacaaaatttatattaacatttgttgatgcccagaatttgggttgttcatccgcaggaagctcagaaaaatatttcatctatggatctagaaggagatttaggagcggttgtcagggccaccagaaaaggttgcgccagaattgatgaactcgatttcgattcctgtaacttgcttaacgcgggcgctgttcttgagcccaagaaagaggttactgttcctatttccatttccatttccgacacagtaacatactctcctttctacggttgcaatccctcgagatccaacaaatctttgcttccctctatgtttgaaaatcttgatcattattatcataacgtggagcagaagcctgcttggtgttgtggaactgcgccggattcctccctgggaaaagccgaaaagaaagatgcagcccatgacctaatcatggcagccacaactagtactattactacaagtaataatcaagaacaagcgagcggccgaattaacgttggtggtgtctgccctcgccagagtttatcgccagtacatgtaaaatctccccccagatctccgacaagacaagacgatccatccgccaaaacgcctgacaaagtcgaagccgactgcagttcttcttcacccatcaaaacggaatctacagccgaaaggatagtgtctaacagggcgactgcatcgggaacaagaggaggaaggagaaatcaacaaaggaggacagtatccattgctgcaaccgaaggatcatggaataaaccaggaggtggtggagttgcatctgatctctgggcatggcgtaaatatgggcagaaaccaattaaaggctcgccttatccaaggggttactacaggtgcagcagctgtaaaggatgcccagcaaggaagcaggttgagcgtagccacacagatcccactaagctcgtcatcacttacacggctgaacacaaccatgcttggcccacttctaaccccagaaacggacttgcactcacaggatcattgagttccacacaaaaagatatgatggcattggttgtaccccatagccctcaaaagtcagatgtactgcctgatgctcgaggttcgaatcccgcggcctctcccactacggctaaaattgaacaagaaaagcccagatctccgccggccacggattgtttagatttcaatttaactgaggaaaccacggattgtttggtggaggaccataaccaaacggccgggcttcatatgattagctctaatcacgtgaactacgacgatctatttgcaggtttaggcgaactgaaggatttcgcaaggtatttttctgattataaatcagacgaagaaaccgacagcacagtagtcgatccttataatctcttcaatttgtcgtctgcttcctccaataaaaccaccgcagattaattattatttctttttcttaaactgggttacaataggggatttgaaatttagatctctggaatgcagtgactattgtaaatgctcattttcgggctaaattatcttctgtgttttccattttgagatcttgctaccataaattccattttgagatcttgctaccataaattaaatgtgattttacaagtttttaaaaaaaaaa

SEQ ID NO: 1971 - DNA, 2700 bp, Pinus radiata
aaacagttggtcaatcagtcctcggtctcaaaaactctggatccaacgtttccttttttctgcaatcgattcgatctcaaagttcctcggtttcagaggacttctggtaagatttctgggccgccctatcgatatttgtatgggtgaagagcttctctttgatagatttagagagcacaattggagattgttctcagggactgaccaggccggtgggttgctagcgtttcgtaatatgatgatgaatggtgcggggagattcgaacacaagaccaccacggggattgatctgtctgtgaaacttgaggaggatgatgatggtgggaggtctgtgcaggagaatggcagccatgggggagctgagaaggataatggttatgataatcgtactgctgagaaggatttcttccaccatgaagttggtcggctgagtttcaggctcttgcctgttgatggtgagagcaaagccgaggatggaactgcggacatgatgtcacaaggcccagaggatgaggatgataaacctgcaaccaatgtttcgactggattgaggttggttaatgtgcaagctgctcgaaacgctgcaagtgatcggtccaccgtagagatggaagattgtgcatctccgatcaattctcaggagacctcaaatcctaatgacatggatggtgaacccaatagcgagctggtcgtggttcaaaaggagctaaatcgtatgaacgaggaaaatcagagattgaggttcatgttgaaccagataaacagcagctacaacaatctgcagttgcagctagcttccctcatgaagcagcagcctcaaaattatggtcatgctgttagagagcaggtccataaagaagagaaattgaacatattcagaggaataacaggaaataataatggtgaagcagcagatgatcaaactcaaactccaattcagaggcaatttctggaaattaaagacctgtcgaggcttaattcaggcactattgctcatgaagactctcatacttctgaagctcgaaggaccctgacccatgcagaaaatgatcaggaggaatcaaaagcgttaatggcgttcaatcatattgataataagcgtgctcgggatcatgacagccatggattaacctcgaaaggccatgacagccctgatcgaacaccctctccgaatccttctcccactcatcatgaaaatgtaggaacccctcaaagggagggcagcctggaccgcagatcatctcccggatgggtgcccaacaagatgcagaagattgtggatcaaactgatgcaactataagaaaagcccgagtttcagtccgagctagaaccgagtcacccatgataagtgatggttgccaatggaggaaatatggacaaaagatggccaagggcaatccatgccccagagcttactacagatgcaccatgtcaccatgctgtccagtgcgcaagcaggtgcaacgcctggctgaagacagatcgattctgataacaacatatgagggcagccataaccacatgcttcctccagcagccacagccatggcatccactacagcagcagctgcctcaatgcttctgtccggttcttccacatcagctgataacatcgcactaaatgcaagcttcatggcaggtgccctcatgcagcatccttgcaacacatcaactgccagcatctcggcctcagctccattccccaccatcacactggatctcacacacaatcccaaccaaatggccaacgctccaggtcacatggcagcctcaaacccaagagcactagcaggactcccagctcatgccatgccctttgtaggcatgccacaccaattccccaccaacacaccccagggggcattattccatgggcaatcaatttacaatgctccttccatgtttgcacccttagcaggccagctgcaacgcccccaacaacccatgatgcccacaccaccaaagctcaatattcaagctggccaaccaccaacaccacaacaacaacaaccatcattcatagacacagtcagtgcagctacagctgccataacctctgatcccaatttcacagcagcccttgcagcagccatcacatcccttatcaacaacaacaacaatgctgccaatgccatttctaaacccaactcctctcaggcactcaatcctagtccccaggttgcagcccatgtcaagtcagatcacacccaatagctatgctagtggcaagattgtattcatgtggcatcactgtatcaattcctgaaagcattttgaagctggaagaaagtttgagtacaggaaaaaaagggagattgtgatttgcaaaagctctccaaggccttaaaatctttttgagaaattgaggttattgattgaggcattccagcacttgggccatggtgtattctaccactggtgaaatgtttgccaacggtggcgatcctctcaatccctttgagatctgggatatattcgtttttggaatttgaaacatttttgaaaattttcagttgtgtacaggcaacttgagtaggttttctttgtatagcttccttatcatacagatatatctatatatatatatcttcagcatcagcttgtgattccaaataatcagcccagtaaataatccaaaactgttaaccagcccataattatatatgaagaactagagtttttttgtcccaaaaaaaaaa

SEQ ID NO: 1972 - DNA, 2463 bp, Pinus radiata
gggattgtctactgtgttttatttgatttcttagagacctgaaagggcattttaatctgttgcgttgtatggaagcagtggggttgagtcttgccgggaacggaagttacagagagcttttggatacttttctgaagcaaaagtgtagaagaaaaggcgatttcatggcggacgctccaagggttgatagacttggcggtatcgatctgtcagtcaagcttgaagagacggagaatgaggagaaattgatgaccgacagagagtctgaaaatgagattaaaaatggcgtggtggatttcttctctgagaaggctgttcgaggtctgggcttcgaattccggccctcacctggcaatggagcgccctctgtggctagtcttggcgaggggttgcgtctcggttcgcagaaaactgagaacaaagaagaagggccctcctcctcctcctccaagggatttaacctttcgctattgcctgccaaaacgggaagcgatcgttcaactgtagaagacgggatgtcacctgttcgttcgcaggagccttccaatccggatgaaggggagcccaagagcgagttgatgatgttacaagtggagctcaaccgtatgaacgaagaaaaccagaggctaagattcatgttgaactacgtaagcaagaactacggtaacctgcagatgcaccttatgtccgttatgcagcaacaacctccgccagagaaggtggaagagaaattgaatggatcgtcggagggagtgaaggtggatgtagccggccccgtgcaacgacagtttttggatctcgtacccatctcgagccacgggaccgattcccaacattctctctcctccgatacccgggatgctgacgatgttgaagagaccgctaagtccattaacaatgaagtcctctcaaagaaacgcgacgtggccaccgctaattccacggataagccacgtacttgtgatgtccgagtccaacaacagcaacaacaacctggtaccgatcctgctgctaattcgtccactgctttgaacgcccaagaaaagggccaccccgatagccccgatcacgagtcctggactgctaacaaggcgcagaaagtggccaataagtgcgctgttgatcaaaccgaagccaccatcagaaaagccagagtttcagtccgggccagatccgaggctcccatgataagcgatgggtgccaatggagaaaatacgggcagaagatggcaaagggcaatccatgcccgagggcgtactaccgatgcacgatggctgttggctgccccgttcgcaaacaggttcagaggtgcgcggaggacaggtcagttctggtaacaacatacgagggaagtcataatcacccgctaccgcctgcagctacagccatggcatcaaccacgtcagcagctgcctgcatgcttctttcaggctctacaacaagcaacgacggaggcttcaattcgagtttcatgcaggccgccgcagggagcctaatgtcgtgctcacccgcctccatggccaccatctccgcctccgctccatttcctactgtcacgctcgacctaacgcaaaaccctaaccctaatatgtatcatcgacagccctccggcttccccatgcccctcggaggtttccaacaactaccctcacacccacctcaaatcttctcccactccctcttcaatacttccaaattcgctcccctcagcggtcagcagttcgatccgcaacaacagcaggtaccccacttttcaggtcacccgatgcagcagcagactcatatgccggtgcccatttctcaatacaaagcaccacaatcgtctctaatggacactgttagtgcaattacagcagatcccaacttcactgccgcccttgcagctgccatcacgtcaataattagcggccagtccaacaacgccaacactattccatcgcaggctcctccctgtgccagggctgataatcctgcttcggctaaattgctccagtgattcttagaccataatttatcttctgccatggaggaccaatctttttgcagagggattcaaattctttgcagatgtaacacttgtgtctgtctgcggagacggtcattcggtggagtaacatgatttgttgagaggtcattacaagtgcaggagtagcaatttggagtacatgttgtgttgatagtcatcagtatagagcagaggccaaacattctttcatacacagggttttctccagagtttgtatctggttggaacacagctaatatatacataacttttcaaagaagaacaaggagagagagatactggctttgtgaataggcgtgtcacatcacattcttttcagctgtatcccacttaaacttgaggtcacaggcctatcctgaaataccactacactacatcttggctgctattactttaaatgacaaaggctattgtgaatatgctaggaaaaaaaaaa

SEQ ID NO: 1973 - protein, 252 aa, Eucalyptus sp.
MEGGQYNPRTVEEVFRDFKGRRAGMIKALTTDVEEFYQQCDPEKENLCLYGFPNELWEVNLPAEEVPPELPEPALGINFARDGMQEKDWLSLVAVHSDAWLLSVAFYFGARFGFDKTDRKRLFSMINDLPTIFEVVTGSAKKQSKEKSSVSNSSNKSKSSSKGGQRASESVKYSKPVQAKDEEEVVDEEDEEEHGDTLCGACGENYAADEFWICCDMCEKWFHGKCVKITPARAEHIKQYKCPSCSNKRARP

SEQ ID NO: 1974 - protein, 252 aa, Eucalyptus sp.; identical to SEQ ID NO: 824

SEQ ID NO: 1975 - protein, 163 aa, Eucalyptus sp.
MRKMKARRKRKTRKRRRRTRSALALVREQKLKIRKMKRKRRRKKIKKKNSRVAEIREPNKRSRIWLGSYTTPIAAARAYDTAVFYLRGPSARLNFPELVFQEDDELRDLSAASIRKKATEVGARVDAQASAAQPPAPEPNSSRVATEKPDLNEYPKAENSDGD

SEQ ID NO: 1976 - protein, 196 aa, Eucalyptus sp.
MAAPGNFSDEEARLASHHPKKRAGRKKFRETRHPVYRGVRLRDSGKWVCEVREPRKKSRIWLGTFPTVEMAARAHDVAALALRGRSACLNFADSAWRLPVPASADTKDIQKAAAKAAEAFQPVESESEDVMSGDEKKSPSEEGMLYDDEDVFGMPGLLMNMAEGMLLPPPRCGGDGYGGEDDGNLDAYVSLWSYSM

SEQ ID NO: 1977 - protein, 349 aa, Eucalyptus sp.
MAAAVEFYNSNSDPIREEFMKALEPFMKSVSPVSSPLSSLSSCDSVFPQQQPNLNPDLCSSWILNPMGLEQSGSIGLNRLSHSQIQHIQDEMLLRRQNQELWLASAVKSPLQHEKFDQCRYQNHHGSPHLLRPKALSMKRVGVPPKPNKLYRGVRQRHWGKWVAEIRLPKNRTRLWLGTFDTAEEAALAYDEAAYKLRGDFARLNFPRSRDGGSYLCDYNPLHSSVCAKLQAICQSLAANSQKQGKTGEPCFFPDRAMETFDAAAEADEAIFFKVALKNEYDADLAYPEQDYKVENSVSSPAFSDESSVAGSSSPESNLALLGFPPSQFEIENFYLEKFPSAEIDWAAI

SEQ ID NO: 1978 - protein, 253 aa, Eucalyptus sp.
MSPEIVERKRSRSRKEGSMSVAETLAKWKQYNDQLDPQANGDKPARRVPAKGSKKGCMKGKGGPENTTFNYRGVRQRTWGKWVAEIREPNRGSRLWLGTFPTAIEAAKAYDEAATAMYGPCARLNFPTASHPMYFGDLDARATTPVGTTANTTGTPSTGYSAGTPSTGYSAGTPSEATTLSSQSELTGGPEVKDGDRKGESNADGGEMEPKSESIVDFDWLSDYAVDDLFDVDELLRTLESDPKFSSDVKMEH

SEQ ID NO: 1979 - protein, 225 aa, Eucalyptus sp.
MPETGPAATAADPIPTTQNFPDSAQREHRFRGVRRRPWGRFAAEIRDPWKKARIWLGTFDSAEDAARAYDEAALSLRGPKAKTNFPLDPLTGLPQAAPSPAALLPRPRPRPRPRGRRRRGPPAEDFHVNRPTSSSLSSTVESYSGPRVSHPAPAVPRVVAVPRAPPEDCRSDCDSSSSVIDDVDDCCVLAPSCFRRALQFDLNLPPPLEDADLDGEELRATALRL

SEQ ID NO: 1980 - protein, 258 aa, Eucalyptus sp.
MKMAERSNSSDPETSPSNSPSTSSSSSSYSPDPRRRAGSPAAARDPSRSSKRSKHPVYRGVRMRNWGKWVSEIREPRKKSRIWLGTFPTPEMAARAHDVAALHIKGSSAFLNFPHLAASLPRPSSLSPRDVQAAASLAAHMPDHQGTVETLRPTAELDSQHSSLPSRSLSSMVSAMDISATVELSEIVELPSLGASCDELGGSEFAFVDSVGAEWGYCYHDDYQPTWPEHLEDCGPYDCGHQTAALPESGGSLLWDYD

SEQ ID NO: 1981 - protein, 190 aa, Eucalyptus sp.
MNFSDKEVQLASDHPKKPAGRKKFRETRHPVYRGVRLRDSGKWVCEVREPKKKSRIWLGTFPTVEMAARAHDVAALALRGQSACLNFADSAWRLPKPASTDAKDIQKAAAKAAEAFQPVESEDIMSGDEKKLHSEEGVSYDEEDILGMPGLIADMAEGMLLSPPQCGEDIYGGEDDGNLDAYASLWSHSI

SEQ ID NO: 1982 - protein, 488 aa, Eucalyptus sp.
MLDLNLEMISSDSSCDNDKNQIDVQEREEEAATKLHEASGNYDMEEDSGTSNSTIVASAEEASGNAGEENSSNTTSSSSIFYIMKEKEKGSKGGFKAGDPPPSPQGLITRQLFPVAGAGEHGHQAAELGLGLPARQQWLNLSFGEPTGAPTEFRILQPKQRKSRRGPRSRSSQYRGVTFYRRTGRWESHIWDCGKQVYLGGFDTAYAAARAYDRAAIKFRGVDADINFNISDYEEDMKQLQMVNLSKEEFVQILRRQSTGISRGSSKHRGMTLQKCGRWDARAGPLLGNKASDNAANKCNGMEAVMNFQPGSYEGDTKPYPRAGGGGHNLDLSLGMSLPSSSSMGAGTQRDMLFHCADHEMPNIVMVGCSSSAHKGGELPNIGMASRSPPIWSTLYPALAPNYEGKAMEKRAEAIPALRFSSYRLPVHGNVNNANNGSQQAQLFTYAASSGFSSSTATPHPPPQLPVSLQKNGVHNNTASRAYFSYRS

SEQ ID NO: 1983 - protein, 201 aa, Eucalyptus sp.
MAELDESSTLELITQYLLEDSINLAQLQPVKTENLFLDPGPDSPDSDHPTWQDLETPNLEIKAEPITLESPESELGSPEKNQDEAGSAAKASYRGVRRRPWGKYAAEIRDPTRKGSRVWLGTYDTDVDAAKAYDCAAFKMRGRKAILNFPLEAGKSAPPPNPGRKRRRVAVKKEESKENLEDWPIEMLAQAERGEDEWTQC

SEQ ID NO: 1984 - protein, 662 aa, Eucalyptus sp.
MEMKSVSENGGGASGGNWLGFSLSPHHLKMEVAPQAEYHQNHHHHHHQYHHQPQQGEPGSYFLSAPPPPPHYSSSGLCYGGGVGDNNNGGYLHSPLSVMPLKSDGSLCIMEALTRSRPQGLGQGSTPKLEDFLGGASATVTATTMPLSLDSLYSYQQSADPEKQSLDLLHEPFRHQQQHQIYYPNELTCPALYHSPLAEEEQKETHIASCDENGGFSCLKSWVTRNFSSSSCHVGLDQMSSGMVCHNGGNSSEAVGPMECGDLQNLSLSMSPSSTSSCVTVPTRQISPTENECVGMEMTKKRSSNCHNKQPVHRKSIDTFGQRTSQYRGVTRHRWTGRYEAHLWDNSCKKEGQTRKGRQVYLGGYDKEEKAARAYDLAALKYWGPSTHINFPLENYQKELEEMKNMSRQEYVAHLRRKSSGFSRGASMYRGVTRHHQHGRWQARIGRVAGNKDLYLGTFSTQEEAAEAYDIAAIKFRGVNAVTNFDISRYDVERIMASSTLLAGELARRTKEIAPNEEVAEYNALTQQKIGSDGTLQLESSGNVTNGSDWKMVLYHSSPQLQASCMESSVNSSQPSVDDTAKLGTRHLSNPSSLVTSLSSSREASPDRAGSAFANKPPVVSKLVNTSPTSASVTSWLPSPAHMRPSAIAMSHLPVFAAWNDT

SEQ ID NO: 1985 - protein, 328 aa, Eucalyptus sp.
MATSSITEVSTRLQLIEQHLLGEFSPTDAAFPAHLAPAPSSYSIPFEPAVEPTRSESLSSVSFSDFDCLPNEDLFEFDVSSFAFEQNQSESFGFEAKPQKLDLIPSVATSSSSSLSSETESFLGFEAKPVIIGETASKTSQSSKKPSLKIAVPRKVELLQFSKANPMVQGGSNQARDEQRHYRGVRRRPWGKFAAEIRDPNRKGSRVWLGTFDTAIEAARAYDEAAFKLRGSKAILNFPLEAGKPRSLVAPADGKKRPREEKEEENEVIVKKEKEAESDVSMWRDGPLTPSCWKGTWDSDDTMGIFDVPLLPPLSPIPTLGFPQLMVK

SEQ ID NO: 1986 - protein, 687 aa, Eucalyptus sp.
MMMNRAEGRGGGGGDDLYTELWKACAGPLVDVPRHGDRVYYFPQGHMEQLEASTNQELNQRIPLFNLTPKILCQVVNVQLLAEQETDEVYAQITLIPAGNLMEPTSPDPVSAETPRTRVHTFCKVLTASDTSTHGGFSVLRKHATECLPPLDMKQATPTQELVAKDLHGYEWKFKHIFRGQPRRHLLTTGWSTFVTSKRLVAGDSFVFLRGDNGELRVGVKRVARQQSSMPSSVISSQSMHLGVLATASHAVTTQTLFVVYYKPRTSQFIISLNKYLEALNNKFTVGMRFKMRFEGEDSPERRFSGTIVGVEDFSPQWDNSSWRSLKVHWDEHASIPRPDRVSPWEIEPFVASVPANIPQSTTKNKRPRPSSEVPADATAAPAIWNSGYTQTHDLKQRRGTDEGKSSDHFMWNYKMADVNSSSSSITRVQTEGGWLPSPCLSVSPNVLPDAVDDSKSVSALPVPCRHPIAHPSSLNNELMPNPAEDGKKVEPTSSCRLFGIDLINHTLSSPPSDKGPFQSMCVSTATTEGHVQMALSTADSDQKCDIQKASEEVKQRQMQNLGKEGQTKQICSTRSRTKVQMQGMAVGRAVDLTMLEGYGQLMNELEEMFDLKGQLQSRDKWEIVFTDDEGDMMLMGDDPWPEFCNMVRRIFICSSQDVKKMSAKSKLPVSSVQEEGTVISSESADN

SEQ ID NO: 1987 - protein, 707 aa, Eucalyptus sp.
MITFIDSKEKLKEVEKTLDSQLWHACAGGMVQMPPVNSKVFYFPQGHAEHSSGPVDFRSCPRIPAYIPCRVSAIRFMADPETDEVFAKMRLVPLTSSEPDFGDDGIGGLQGSDGQDKPASFAKTLTQSDANNGGGFSVPRYCAETIFPRLDYSVDPPVQTILAKDVHGETWKFRHIYRGTPRRHLLTTGWSTFVNHKKLVAGDSIVFMRAENGDLCVGIRRAKRGIGSGPESSSGWNPVGGNCAVPYGGFSAFLTEDENKLITNGHGNCMSGNGSLMGKKRVTPEAVVEAASLAANGHPFEVVYYPRASTPEFCVKSSLVKTAMQIRWCPGMRFKMAFETEDSSRISWFMGTISSVHVADPTCWPDSPWRLLQVTWDEPDLLQNVKRVSPWLVELVSSMPAIHLSPFSPPRKKLRLPHHPDFPLDGHFPMPSFSGDLLGPSSPFGCLPNSHSAAGMQGARHAYYSQSLPDLHLSKQPSSLFPAGFPLLDHSIRSMRTSNGPRMHKSSSDDDISTLLTMTNYGKVFKKLEEVKKPPQLVLFGKPILTEQQISLSNSATTTTTTASPVRTSSEEKIDKTGSFPDGPDSARQQSGQREQQSSCEQLRVHEDKHQQEMEACSEIGHCKVFIASEDVGRTLDLSLLASYDELCRKLTDMFGVENSQSLARHVLYRDDKGAEKRIGDEPYSDFIRTARRLTILTNSSSNGVGS

SEQ ID NO: 1988 - protein, 619 aa, Eucalyptus sp.
MSSCVESHDRSSSSCGNIGTGRGDNLHEQLWHACAGPLAYVPKAEETVFYFPQGHIEQIEAYTNQDGDMEMPIYKLPSKILCKVVCVQLKAEIHTDEVFAQVTLIPEAKKDEVNPNCKTSATPPRDNSRFFVKILTQSDTSTHGGCSLPKRPADECLPSLDKSQHHPVQDLVTKDLQGNLWCFRHIYRGKPERHLLTRGWSDFSTSKKLVTGDACIFLSGRDGDVRIGVRRLMKSQTTTSSSILSGHSMRHGILASALHAVSTGTMFTVYYRPWACTSGFIIGYQQYVKAMANDYSIGKRFRMQFEDELCGEQRLRGTVVGIEDLDQMRWPGSDWKCLKVQWDSSRVKCICPERVSPWDIESLDPDGKKQAVLPTSLKRTRPCSLQLDWPPTFVMDESQWTSVAPKSQRQPVVFQGDGGKRESRGPGDHWPPASIAPGCNPVKSLPAQDVMPANSTSWEARTTFETKDDNEKTLAQTNRFGKCKVFGVSLADDTSELPSLQVSNSSELSSPSSVPPLSKSSDFVQVIINETARGRPADLSPFKGYDKFIHGLDQLFYFGGNLIGRSSGWHEKCTDDNGDSVPIRDYNREFVSMVHQGLICPKEEEQGKQGPCSSDVVSS

SEQ ID NO: 1989 - protein, 207 aa, Eucalyptus sp.
MSEAMSIFLHNHIHILIDITQCSRKKEQASYGFHFTVSCDENPFVTIKPCARTLLRAQVVGWPPVRSFRKNMVAAQKSSTEDMSSGGAASFVKVSMDGAPYLRKVDLKMYKSYQELSEALCKMLSSFTIGRCESQGVKDFMSESKLRDLLNGSDYVPTYEDKDGDWMLVGDVPWEMFVESCKRLRIMKGTEAVGLAPRAMEKCKSRS

SEQ ID NO: 1990 - protein, 191 aa, Eucalyptus sp.
MAAQGEDLNLEATELRLGLPGTVEPEKQQAPLSGRSMKRNLIDVNNEYGSNEEESNGSSAQKCDKQDVHRPSKAQVVGWPPVRSYRKNCFQKKAEGESTGVFIKVSMDGAPYLRKIDLKPYKGYSDLLKDLQDMFKFKVGEYCEREGYNGSEFVPTYEDKDGDWMLVGDVPWNMFITSCKRLRIMKGSSEV

SEQ ID NO: 1991 - protein, 191 aa, Eucalyptus sp.
MAAQGEDLNLEATELRLGLPGTVESEKQQAPLSGRSMKRNLIDVNNEYGSNEEESNGSSAQKCDKQDVHRPSKAQVVGWPPVRSYRKNCFQKKAEGESTGVFIKVSMDGAPYLRKIDLKPYKGYSDLLKDLQDMFKFKVGDYCEREGYNGSEFVPTYEDKDGDWMLVGDVPWNMFITSCKRLRIMKGSSEV

SEQ ID NO: 1992 - protein, 204 aa, Eucalyptus sp.
MEFREMERGVGDGVFGKDLLNLEETELRLGLPGTEESGQKKSRTGKRLFSESSDVSGSSKGSCVAPHHDEDHESAPAPKAQIVGWPPVRSYRKSALQPKKAEAEGPGIYVKVSVDGAPYLRKIDLKVYGGYPELLKALENMFKLTIGDYSEREGYKGSEYAPTYEDKDGDWMLVGDVPWEAFILSCKKLRIMKESEARGLGYGV

SEQ ID NO: 1993 - protein, 183 aa, Eucalyptus sp.
MEMNKKDVKHQDTELRLGLPGTEGLKCANNNKRSFIDTKEVSTSPKEDCVTNNTPPPKAQVVGWPPVRSYRKNCLQAIKKEAENGNMYVKVSMDGAPYLRKIDMKLYSCYQELLKSLEDMFKAQVGEYSEREGYKGGEYVPTYEDKDGDWMLVGDVPWEMFINSCKRLRIMKGSDAKGLGCMQ

SEQ ID NO: 1994 - protein, 620 aa, Eucalyptus sp.
MVGGGIEMKIELGAGYGPWNDEEKAMVAAVLGTRAFDYLVSRSVSNENLLMSIGSDENMQDKLSNLVDHPNSSNFSWNYAIFWQISRSKSGDWLLGWGDGSCREPKDGEESEATRILNLRLEDEGQQRMRKRVLDKLHTVFGGSDEDNYALGLDRVTDMEMFFLASMYFLFPSGEGGPGKCFASEKHVWLTDALKSSSDYCVRSFLAKSAGIRTIVLVPTDVGVVELGSVRSVPESSELVQTIRLSFSTNSFMSVKPIAALPMTNEKKDENAPFSNLALAGKGEAISKIFGKELTAVNSPGHYREKLAVRKMDSRQSWEPHHNGSKLPFSTPRNGTQDTSWAHHAHGVKQLSPVEFYGSQTSASKLEERMNSGRNDFGLNRYPTPKQVQMQIDFTGATSRPSVITRPFTADSEHSDVEASCKEEQGGAANEKRPRKRGRKPANGREEPLNHVEAERQRREKLNQRFYALRAVVPNISKMDKASLLGDAIAYINELQAKLKIMEADRERFGSTSRDASDVEVNATAEQSNQSPDVDIQATAADEVVVRVSCPLNSHPASRVIQAFQEAQVTVLDSKLSTANDTVFHTFLIKSQGSEQMTKEKLTAAFSRESNSLEPLSSVG

SEQ ID NO: 1995 - protein, 564 aa, Eucalyptus sp.
MELPQPRPFGTEARKATHDFLSLCSHSTLHHQDPRQPPSQDSFLKTHDFLGKTGAKEEATSEISSSLERPPPPAPPGPPPSVPPPQSVEHVLPGGIGTYSISHISYFNNQNPPKPEATIYTVAQASSTDRTDENSNCSSYTNSGFTLWEESAAKKGKTGKENVPSASVREAEVKLGPWPASERPSHSSSNNNHRNSFSSLSSSQPSGAKNKSFMDMIRSAKSGSNQEDELDDDDGEFLLKKETSPIPKGELRVKVDGKSSDQKANTPRSKHSATEQRRRSKINDRFQTLRSLIPNSDQKRDKASFLLEVIEYIQYLQEKVTNYEGSFQGWSQEPANMMPLRNGQRPTDNYVDQSQNITSGSSPALVFAAKVDENNIAMAPAVFRKAKNPLEPEMGSVTAFKSVEHHPGMTNRAVPFPMSLQPNISNCVRGSGAVARGDPNLENNASQPLTQISRIKSLTNECSASTDKLKEEELTIEGGTISISNVYSQGLLNRLTQALQSSGVDLSQASISVQIELGKQANGRNATSSSLPKDTEARNQGVTRPRAAGEIADPALKKLKTGKS

SEQ ID NO: 1996 - protein, 288 aa, Eucalyptus sp.
MALEAVVFPDDPFNYYNCKEVQSLLGECWSFDFGDQEQCENSHFLSTLEIQTEDHECSGWNDQSNVSSKALIDRPKRCRYKRRKNKKEMESQRMAHIATERNRRKQMNEHLSVLRSLMPDSHVQKVDQASIIGGAINYVKELEQQLQQLGAHKEMEGQSSKCEDDISSPPFSEFFTCPQYSASPDQGNDSVPMNEWTSLTQSAIADIEVTMVETHANLKVRSKRRPKQLLRLVSGLQSVGLTVLHLNVTTAEPFVLYCLTLKVEDGCQMTSGDEIAAAANQILSSIQE

SEQ ID NO: 1997 - protein, 498 aa, Eucalyptus sp.
MGGASLPTFKSMLDADWSYFATNPPHHSQQQQQLQPAPEMADLSFSSAAPIPDNALLLHHSHHPHPLDSSSSCSPSQAFVLDPSQTHQPFLQPKHCFSSLLNVAWNNSFDNGFDLGCDAAGLFGSVQGNQTSSAPLLMGGSELGSGSELLPVPSRLVPLGENSTQLPGGGFGLTGFEGFESPGNPLFTNRSTKVLRPLEVFPQTGAQPTLFQKRAALRNGSGSNGGGAEKLGNLEISVSRFGELDKKRKKIDDGINDELSFDGSGLNYDTDEGNESGKAMEDSKHEGCNSNANSTVTVGDQKGKKKGLPAKNLMAERRRRKKLNDRLYMLRSVVPKISKMDRASILGDAIDYLKELLQRINDLHNELESTPPGTMLPPSTNFHPLTPTPPTLPCRVKEELCPSSLPSPKGQPARVEVRVREGRAVNIHMFCARRPGLLLSTMRALDNLGLDIQQAVISCFNAFAMDIFRAEQCREGQDVLPEQIKALLLESAGFHGMV

SEQ ID NO: 1998 - protein, 897 aa, Eucalyptus sp.
MTFSLPPQVSGSGPSEAPPGGWEAKDRVQMLIERMMTKAQISVVGEGIIGRAAFTGDHEWIASTSYGGHAHPPEVVNEVHHQFSAGIQTVAVIPVPLHGVVQLGSSIAIMEHMGFVNDVKSLILQVACIPGALFSSSSAGKAGMLGYPGSLTAAAPGNCQVIGSESLMTKSCKDTSNSSRTAGFVRQSSPLITNTVDNLQPAASTLLTLEKATSLAELCSHLSKSSRASLMKTSLSPRHGVDSGLARAEVIPANLDMWLNQHAVACNLGNDNRGQTALGPTDGTWSFFEPIKKKVSAGVVLEKPENKWNSFINSTVTAQPGRNQCSIINPCKTSDATQFHQNAKLLHGVTCPPRSISVSCSLSESVSRNLVANASFHDADSTKLEGIPLFNLSEQLLSGASGQRNHLMSTKRGQTELPSKKQRVVDNFSRQVMPPDYSDISLIEQKPEWALSSEKLEGGSQKVISSCDTYENASVQQLVRNDLFDILGTDMTDNIIDGNLESLLTDGPYFDAHKSGAEASSVVNLQETQTDLGSLSEGVSESGIFSMTAVDNLLDAVVSGTRPTSKPISDDNISCRTSVTRISSSSVPSSSSLNKNFNMLNQEHKDFCGIQKSLVKAGVSDSGSLRSGCSKNGVEMCSVSNSFYGSHISSWVDQGHGIKQDDNVSTGYSKRQDGMIKSNRKRLKPGENPRPRPKDRQMIQDRVKELREIVPNGAKCSIDALLERTIKHMLFLQSVSKHADKLKQIGGSKIINEEGRILLKDNFERGATWAYEIGSQSMVHPIIVEDLNPPRQMTVEMLCEERGFFLEIADMIRGLGLTILKGVMETRSDRIWARFAVEADRDVTRVEIFMSLVRLLEETIESSPLVANSIDGKTPMVCQPLTRATSIPATGGHNVLQ

SEQ ID NO: 1999 - protein, 495 aa, Eucalyptus sp.
MEELIISPSSSPSLASKSMSPTATPPPSLSLTLQQRLQLMVQSQPQWWAYAIFWQLLNHDDGRLLLAWGDGHFQGSTKLTLASRSDRRRLLQALPRDPSNSRPDAAADVPLPAPAGDVTDAEWFYVMSLTRSFSAGDGIPGKALSTGSLVWLTGARELESYKCDRAKEAELHGIRTMVCIPTGDGVLELGSCDVIPENWGLVQRAKSLFGSDLLLPKHPPPPPPPFQLHHDHSDISFADIGIIAGVQENDFAPHADHEKKVKKKQPLVEGAGGRPEAPFGCSSYLVESEHSDSDSPFMAAVMTEKRTPKKRGRKPGLGRDTPLNHVEAERQRREKLNHRFYALRAVVPNVSRMDKASLLSDAVSYINELKSKIGDLESQLQRESKRVKQEVTDATDNLSTTTSVDHSSPSGCGGSLLEVEVKIVGCDAMIRVQSENANYPSARLMAAMRDLELHIHHASLSTVNDLMLQDVVVSVPEGLKGEEDLRAALLRALEQ

SEQ ID NO: 2000 - protein, 370 aa, Eucalyptus sp.
MESVMHNPPHLQQLNSSLMRYRSSPSSFFDCLVNGNGSDIGCEDYSYPHSLSPEMDAAIVKLMSIDGFESNDMQEDGRRSVKQESEVVFRTSVSPAMDGTSPVHRHLDHEILANSIGFGSFFDEANSMVLQSNAPAELGSGKRSNLVRQSSSPAGLTSNIAVEIGFDARRDAQNLEMRKGDGSFCSKSKSVGQTDLRSTSISTSRHMPQIAEMENENKLDRMRKSWKNTTFNGLKRVREEDANLSSSIHTMENQDNVTRNRTHGLTHHLSLPKTSTEMAAVGNILHFQDSVSCKARAKRGCATHPRSIAERVRRGRISERMRKLQDLFPNFDKQTSTADMLDMAVVYIKDLQEQVKLLSESKAKCICSSK

SEQ ID NO: 2001 - protein, 411 aa, Eucalyptus sp.
MEGCDGGDVGFRHGGDNFLNFPHSGVTPSSVREEFSGMAINPFVSSGWDPLVSLTQSYRFANPSMASGFPFSSHPGIMENQRSGGDFPPPLGHNLSALTEQVSFERLPCSESRSYLDAVGYFGLPDIANSGCPPNYGSQREDDHDGSEGASANNKLSQDCRIEEDGEGSSPSVKRRKNAPAHDTIYDSKEVKRDPSRVISDVPKEWDEKKQKNEQTLHPNSQGKQTGKQVRDNVEAPKENYIHVRARRGQATNSHSLAERVRREKISERMRMLQELVPGCNKITGKAVMLDEIINYVQSLQQQVEFLSMKLAAVSPELSINLERILSKDIFCSPGSSATIMDTERGIACSSPYTKGFFPEAFPSLPSSNHHYPPLTQAFCESELQTQCQSHFLSSSGVDSLGLNGRLKSER

SEQ ID NO: 2002 - protein, 521 aa, Eucalyptus sp.
MDNEFFMPWQPLSSGMAIQPNDLNCASKQSPDCFFNPNWDNSSADQGGHFESALSSMVSSPAAAGSYLSNESVLIRELIGKLGSIGNPGEASPSPHSLPLSGNATAAMPYIGGSNSTNTSCYNTPLNSPPDRAVKERFSSVAEFTADPGFAERAARFSCFGSRSFNGLTSQFSLNNGEPPYKSNPLMESGKFQRVLSSPSLKALGSQAVATVQQNVISRLSDRIELTNSNEESSVSEQIPGGENGLKASNEANSRKRKAAAKGKAKESAPSTSVANAMKVSESHDNSSPKRCKPNEDDGNGNDTAKGEDDAKGNSKKNDAKPPEPPKDYIHVRARRGQATDSHSLAERVRREKISERMKLLQDLVPGCNKVTGKALMLDEIINYVQSLQRQVEFLSMKLASVNTTLDFNADALMSKDMFQPNNSVPRPMFPLDSSATAFHGHHRPQNQPLPPPLQGHVSSGTATQVEPLNLGPCHTVESHSPLNDLQYQNFCGDDLQSIVQMSFGQNSNQETAFQLQTFHG

SEQ ID NO: 2003 - protein, 346 aa, Eucalyptus sp.
MANNPSDGASDEFLEHLLGLPNFAAAAEAGLAPGDGTGLSVTAATPMMLQLGSGDGSGGHGHGHGHGHGQGHLSALGGGGAGAGGGGGGGGGGYHGAVFPLGLSLEQGKGGFLKPEEASGSGKRYPEEVVDGRASTVKNLHSPLPNFPDVSQMASFRNRDVFHGQPVPNPVPAAPHPPAMRPRVRARRGQATDPHSIAERLRRERIAERIRQLQDLVPSVNKTDRAAMLDEIVDYVKFLRLQVKVLSMSRLGAAGAVAPLVTDIPLSSVEEEGGEGGRNQPAWEKWSNDGTERQVAKLMEENVGAAMQFLQSKALCIMPISLATAIYQTQPPDTSSLVKSESNPPS

SEQ ID NO: 2004 - protein, 540 aa, Eucalyptus sp.
MENDFFMCGGALVPPPPPPLQCAEMNCFYNPSWEKSTVDHGVAKFDSALSAIGSSPAGSTSNSNLSNGSFVMRDLVGKLVGVGNSSELPPHSHHLFSAMPAKTDSHVGGDNSTGNSCYSTPVNSPPMTDRLFQDNHHLPKLGHAVMPMNSGLAEFSPDPGFADRAARYSCFGSRSFNGRSGQFSRKYGEIVNRSMPPMADEKLTRVSSGPSLKALESQMAAEQSKNSPPQDRGELSNSQEGSSLSEQIPSVEIGLRASNDAGLRKRKAVPKGKAKGSAGTLPSSNDAKVDEANENSDAKRCKPDESAGNENCSGKAEHDPKESTGTASEDKQTKTEEKDYIHVRARRGQATDSHSLAERVRREKISERMKILQDLVPGCNKAIGKAVMLDEIINYVQSLQHQVEFLSMKLASVNSGPDYKMDALMSKEMFRSNDPIQYPILPPDSSAASVLYGHHRHQKNSAVHNHITEGTTAQFSMDPLNEPHFPPLDGLNDHVLASFCGDDLQMLVQMGFGQDKLTDAPLDHQDYHGQNPVSHMKIEL

SEQ ID NO: 2005 - protein, 258 aa, Eucalyptus sp.
MESIDEEFRNYWETLMFFQSEELLHNSCVSEVISRFNGPSSPDAAALPVASKSIDLERNRRKKLNERLFALRALVPKISKMDKASIVKDAIDYIQDLREQEGKIRAEIAELESVILKKNPGFKFEGERSPPAHPKSKRKRAKLRHDISKSPDITPIEVLELRVMEAGEKSVVISLTCSNRGDAMVRLCQAFESLKLKIVAANITALPEELLKMVFIEKEEKQGKEHIQSKIQAAIAALNSHHAEPTDASMKQLMSRDI

SEQ ID NO: 2006 - protein, 285 aa, Eucalyptus sp.
MAAATTSPNPIRRNGSFAPERESFHKFFECWLVEQNQHLHDLISASSPARDGDDQALRPLIDRVMLHYEQYYKAKSRSAKQNVLAMFSPTWRSSFEDAFLWIGGWRPSMAFHLLYSKSGLQLEAQLAELIRGLATSDLADLSPSQLALIDDRQRTTIHQEKAITEKFAKHQETVADASMVELSHTITEMMHAGGGDAAVENEAAMEEEVESALTAKEEGLEEILQMADDLRLSTLKEILNILTSMQAVHFLIAAAELHLRIHEWGKKKDEAQAQTHHVEAHATAQ

SEQ ID NO: 2007 - protein, 303 aa, Eucalyptus sp.
MEDLELHMDEDVMAHIDLDGFFGDLPEAGDVIGACSSANGSSSSPDSGLSWFDEIENILMKDDEDGGVVGGGIRADSSQEFCDRFLADVLVDSPGDGSAVIADDGSGDKEEPGSSDDGGVEAAKVDGADGGGEAYDPASKKIKRQLRNRDAAVRSRERKKAFVKDLEVKSKYLEGECRRLGRLLQCVMAENQALRFNLQNSACGASVAKQESAVLSEPLPLGSLFWFLCITCLFTLPPPLLLALEAVLRENAGRGNLKPLAAPRGARSEMFGSCGVQTLDKSRRYKALRTKMKAGFLLPRVLA

SEQ ID NO: 2008 - protein, 470 aa, Eucalyptus sp.
MASHRIGEIGLSETGPSTHHVPYSVYHGINNPTTFINQEGSAFDFGELEEAIVLQGVNIRNDEAKAPLYAGRPAATLDMFPSWPIKFQHTPRGSSKSRGESTDSGSGVNTNTLSSSIAEARREADSPVSVKGSSSLDHQKLQKPMEMAASDTSPLPSPSQSASKAPQDKTLRRLAQNREAARKSRLRKKAYVQQLESSRIKLTQLEQDLQRARSQGFLLGACGGANISSGATIFDMEYARWLEDDHRHMLELRTGLQAHLPDGDLRVIVDGYLSHYDEIFRLKGVAAKSDVFHLITGVWATPAERCFLWMGGFRPSELIKILITQLDPLTEQQFMGICSLQHSSQQAEEALSQGLEQLQQSLVDTIAGGPSIEGMQQMAIALGKLTNLEGFVRQADNLRQHTLHHLRRILTVRQAARCFLVIGEYYGRLRALSSLWASRPRESMMNDDNSRQTTTDLQIVQATQNHFSNF

SEQ ID NO: 2009 - protein, 329 aa, Eucalyptus sp.
MEEGKAGGGAEKMKKSASELGLEESMRIMMIAPSPEHHHLDHHPPHNYCYDSPHTTSISCITDAPPLSFHDWDISGPGSDHQHDMATAITAFWDPPLLTEHSPPDSNSSIFVGSSTSLANKPKYRDIQAREATSGSSRQHSDEDDAATVADPSEQSRYPTDPKRIRRMVSNRESARKSRKRKQAHLAELEIQADRLRGESSTLFKQLLDAAQHYRHADTNNRVLKSDVEALRAKVKLAEDMVARGPFPCSLNHVLQTLNHQHSIGTRGLSAVANVSPTITVHGDNDSSTGLTVPMPNSCLGVENSNPNNSNFTNGVIHDPVSFVSGIWS

SEQ ID NO: 2010 - protein, 398 aa, Eucalyptus sp.
MGSSETEKSAKEKETKGPPPTTLEQSSTASANPVTPDWSGFQAYSPIPPHGFLASSPHAQPYMWGVQHIMPPYGTPPHPYVAMYPHGGIYAHPSMPPGSYPFSPFAMPSPNGIAEGSTTGEADGKPTEVKEKLPIKRSKGSLGSLSMITGKNNELAKTSGASANGAYSKSAESGSEGSSEGSDDNSQNDSQQKSGGRQDSLEDVSQNGNAEHGSQNGGSNTPHGTVNQSVALVPIAAAGPAGVPGPTTNLNIGMDYWGTPAMPAIRGKVPSTPVAGGMVTPGSRESVQSQMWLQDEREIKRQRRKQSNRESARRSRLRKQAECDELAHRADALKDENASLRAEVSRIRSEYEQLLAENASLKERLGEVPAHEDSRSEERHLNSESQKTAKTEHGQNAR

SEQ ID NO: 2011 - skipped

SEQ ID NO: 2012 - protein, 326 aa, Eucalyptus sp.
MASQGGGGSSGNARGGGGNNGKSTEVQPLTRQNSIYSLTLDEVQNQLGDLGKPLSSMNLDELLKNVWTAEAGQSMFMDVEGTAVANQNALPRQGSVSLTGALSKKTVDEVWRDIQQNKNREENKSKERQPTLGEMTLEDFLVKAGVVAESSSDKRSTGNIGGVDPSITPQVPPQGQWMQYPQPQFAHPQQNIMGIYMPAQTMPQPLQMGAGSMMDLPYPDNQLALPSPLMGTLSDSQTSGRKRGVHEEVVDRSVERRQKRMIKNRESAARSRARKQAYTSELENKVSRLEEENERLRKRKELEMLLPCAPPPEPKYQLRRTTSAPF

SEQ ID NO: 2013 - protein, 285 aa, Eucalyptus sp.
MADGSPRTDISSDDTDEKNQRFDRGKSTAIVAYDSSDRSKDKTDQKTLRRLAQNREAARKSRLRKKAYVQQLESSRLKLTQLEQELQRARQQGIFISSSGDQAHSSGGNGAMTFDVEYARWLEEQNRQINELRSAVTAHAGDGELRIIVDGIMAHYDEIFRLKSNAAKNDVFHLLSGMWKTPAERCFMWLGGFRPSELLKLLVNQLEPLTEQQLTGIGNLQQSSQQAEDALSQGMEALQQSLAETLCSGSLGSAGSSGNVANYMGQMAMAMGKLGTLDGFIRQVI

SEQ ID NO: 2014 - protein, 463 aa, Eucalyptus sp.
MSPAVMIPHKNAANAFSGKTARACDNCIQRRARWYCAADDAFLCQSCDRSVHSANPLARRHERVRLKTAATPQKHLGEFSSHHRKKPSSWHRGFTKKPRTPRGAKSALHRATKPENAARNPFPVVPEVGGDETSNEESEEHLLYRVPAYDPFVAEMCTSKGAEATAFSAEPETVAAFDGSGDGDNRSKGLADEVENLQEFLPSDADLAEFAADVESLLGRALDTESFGIEGLGFVDCKERDDNSMDCSLGSGGAIKVEEKEGVAEVVVELGHDDMEMDVSKETFELNFDYDSPTTCGDEEEEAKVIVELEGEKNVENCGADEGTNISSEERKKKKKREIFLRLDYEAVISAWAGQGSPWTTGERPDFSPDNCWPDFMGMSGLEFQNLYGEAGVHGGHVGMGDAGREAKVSRYREKRRTRLFSKKIRYEVRKLNAEKRPRMKGRFVKRASSASSSAPAFPLLNK

SEQ ID NO: 2015 - protein, 256 aa, Eucalyptus sp.
MDTAEWRQGIGVIKAMEGSSRPALRSRPQKDQALNCPRCTSTHTKFCYYNNYSLSQPRYFCKTCRRYWTEGGSLRNVPVGGGSRKNKRPSSSSPSTSSSSSKNKIIPNLTPPPPTILHSDPQNPNNKPQEGQGFGLPSYLPAQAYAALSHHLPNPSSSSSPMEFLKSGGSWPSGLSLSSLMAIPGSDSSACMYSASAGFPLQELKPNLQYFSLAGLEAGEFKQVPSRTAELEQMNRGQHGDPSTGYWSKLMGGGSW

SEQ ID NO: 2016 - protein, 255 aa, Eucalyptus sp.
MPSDARPQASAAAAAGGAGLHPHPPPQTEALPCPRCDSTNTKFCYFNNYNLSQPRHFCKSCRRYWTQGGTLRNVPVGGGSRKASSSSSSKRPRSLAPPTSSSPCSNSNSSSVSQEPLHGDHSGLLLAQVKSEVGSGDQVKRTENVAGPGVGSGHQGFTSLLGSPGGQGFLALGGLGLGTGLDGLGFGFGRGVWPFNEVGFVDGGGVYGGGGGGGPVAAAGGNAWQMGSGEGGGLVDGDGFAWPELAISMPGQGLK

SEQ ID NO: 2017 - protein, 214 aa, Eucalyptus sp.; identical to SEQ ID NO: 967

SEQ ID NO: 2018 - protein, 443 aa, Eucalyptus sp.
MLEMKDAAIKLFGQTIGLREKRGVLDEPSWGGGKEFASEAGGPGSWDRGGSVSADAAWQEHRGGREAGETRGDKALSEREPMNDKYEEGISCWAVDNPKDSAESTIINQKDETGRETSPPSAQNKEESETSISRETTLKKPEKILPCPRCNSMDTKFCYYNNYNLNQPRHLCRKCQRYWTAGGTMRNIPVGAGRRKSKNSYAATVALFHNTGVPESLRADCAGDLKTAGTTILRFGSDSPNWGQSAAPVPSTINGFLDPGRAIPCSGRGLDNFSDERSCGSSLTASNSTEKASNCSAPEPAAHNYRGFPLDSVQWNSPTAVSTPGFPVSFYQAPQCYWAYALPGSLPSSLSHSNASTSPPSLMILGKHSRDGNVYDCRATTKQSIIGAREALDGVSDSGESDGFFSQAFQSIAKGKSFNDRRTLLLQANPAALCRSMNFQEST

SEQ ID NO: 2019 - protein, 396 aa, Eucalyptus sp.
MGYICEFCGEQRSMVYCRSDAACLCLSCDRNVHSANALSRRHSRTLLCERCNSQPACVRCAEERVSLCQNCDWIGHGASTSASTHKRQTLNCYSGCPSAAELSSIWSFVLDFHSGGESACEKGMGLMSIAEGNENAACIPPKDSSSQDVSVCADDEAGNANAWVGSSSLPELKSASLNMGQLAASASTATPKACLPITRSPGLFEDDRFYEDFNMDEVDLDLENYDELFGVALTNSELLFENGGIDSLFGAKEMSAADSNCQIQPACSVASAESMMSSKTEPIICFSTRQPHSNLSFSGHIGENNTGDYQDCGASSMILMGEPPWCTPGPENSFTSASRSNAVMRYKEKKKTRKFDKKVRYASRKARADVRRRVKGRFVKAGDAYDYDPLSQTRSY

SEQ ID NO: 2020 - protein, 124 aa, Eucalyptus sp.
MALEALSSPTAPSAPFQFMKDSSPAAAAAAASSSSSAYDLPIPASFSAPSAAAAPAASGVSVSEGVGSTHTQSQGHREFDLNIPALPEFSPRFVVSGGVDDEVESPHPSKKPRFLAPAVKTEAA

SEQ ID NO: 2021 - protein, 368 aa, Eucalyptus sp.
MTDPYSSYLNGWINFNPLHHCSPSPPPPPSSSFSSIATNNYYNSSHCFYSLYDYNHVYSAASLPHASPPPSPPLKEALPLLSCLSPARHEEEEQASLSTPMEVENPSCQKDSFFPHNSADGADEDDDGDGEAVTVALHLGLPSPSSADLISRLSSTEISSDKELDQETTVASSGYFTSNNKLNKGQYWIPTPAQILIGPTQFSCPLCFKTFNRYNNMQMHMWGHGSQYRRGPESLRGTQPTAMLRLPCYCCAPGCKNNIDHPRSKPLKDFRTLQTHYKRKHGIKPFMCRKCGKAFAVRGDWRTHEKNCGKLWYCSCGSDFKHKRSLKDHIRAFGSGHTAYGIEDDCGFEEEEAATSEIEQDNNFECSK

SEQ ID NO: 2022 - protein, 485 aa, Eucalyptus sp.
MSNITGEGGSFSSGNTGEAEVQPQELLNHLFGANNSLLSSASANNDSLSASTHDEKPQQQAPQAKKKRSLPGNPDPSAEVIALSPTTLVATNRFVCEICNKGFQRDQNLQLHRRGHNLPWKLKQRGSAEIRKRVYVCPEPSCVHHNPARALGDLTGIKKHFCRKHGEKKWKCERCSKKYAVQSDWKAHSKTCGTREYKCDCGTIFSRRDSFITHRAFCDALTEENTKLNQALAPHLPSSVGQQPNNLSSSSVPLSQAQSNTIPSTEAPEFANHADTKPPLFSLPQGLILHQSKPMTMPQTLFSGNNLFGTTNARTVAPPPISPSLIHGMNSPQRGSAFMSATALLQKAAQMGATVSNNSATSFVSAPMAPSSFGGMLPKQAQHNGGFVDRFMEKGQEEISEQFMNNVNNGSDREGVFSGLLGQNSHDFLKSLEVDHGKTTTVDFLGIGGTRSAGNLHEGQREMPLKGFMSQFQPQSTMEKPMWEV

SEQ ID NO: 2023 - protein, 368 aa, Eucalyptus sp.
MTDPYSSYLNGWINFNPLHHCSPSPPPPPSSSFSSIATNNYYNSSHCFYSRYDYNHVYSAASLPHASPPPSPPLKEALPLLSCLSPARHEEEEQASLSTPMEVENPSCQKDSFFPHNSADGADEDDDGDGEAVTVALHLGLPSPSSADLISRLSSTEISSDKELDQETTVASSGYFTSNNKLNKGQYWIPTPAQILIGPTQFSCPLCFKTFNRYNNMQMHMWGHGSQYRRGPESLRGTQPTAMLRLPCYCCAPGCKNNIDHPRSKPLKDFRTLQTHYKRKHGIKPFMCRKCGKAFAVRGDWRTHEKNCGKLWYCSCGSDFKHKRSLKDHIRAFGSGHTAYGIEDDCGFEEEEAATSEIEQDNNFECSK

SEQ ID NO: 2024 - protein, 544 aa, Eucalyptus sp.
MEMKGLLAVNDNSMSNLTSSASGEICASSGSGSEIYGNNNNLYSHHSFASANHQPSPPPKKKRNLPGNPDPDAEVIALSPKTLMATNRFICEICNKGFQRDQNLQLHRRGHNLPWKLKQRPKDEPIRKKVYVCPEPTCVHHDALRALGDLTGIKKHFSRKHGEKKWKCEKCSKRYAVQSDWKAHSKVCGTREYKCDCGTLFSRRDSFITHRAFCDTLAEECAKTAPPNQPNFLIPSSSQPPTTSLVTSRINLQNISSLSIKREQEQQQHQQQVHIFNPRQQTIGPSWTPLPYISRGTLSSPSSFLDPSAQVLQNPSSDNPSAGISINLPHAEHTGTGFSSPSSSPHMSATALLQKAAQMGVTMNNQPSSSLGVNCSAPQAHHSRMHDNNLVNLGSRDRHHHRPQDHQMGTGRFADQSLSSFGNKAVAAPAGVLGGAGEPGPPLSLLQQDMNVMMMMNPLSSLDGADDDLNEMILNNNYGDDISERPSSGHGGDDFKGAATLESAKRYRLEGDKDSMATRDFLGLKAFSPKDFLNHKVAGFDPMV

SEQ ID NO: 2025 - protein, 305 aa, Eucalyptus sp.
MRELENNSLDLNNLPEDYTRDGNKQVFEGSSSSSVPLNGRRKRDIVITCQARSEKASFELLQCGPKVLIFLKIRERVDPKSIFQIVWKKKSDGKEECGKVYECRFCSLKFCKSQALGGHMNRHRQERETETLNKARQLVFGNDTLAAHPALPPHHHLASCQSIPGGYHAATNVADPPLPFRSSMYPPPPPPRFFSASSSSSIVQPPPPYLYPSPPRLVAYPSHYNGNQHPPAGDNYSMGHVFGRSPSSHFGTLESNYTCIGAPVGEGFSAPGGGGRERSPQGQKEGSNWVSRLDPPSINRFHDGF

SEQ ID NO: 2026 - protein, 528 aa, Eucalyptus sp.
MDSKMDLEERLRAETWGKPSSVNDLPQRVPPDRQTPFPNFASHKNLQKREDQDPSISNYGMRIEPSFSEFNRPSECQPPLPSNPISQDRGVQMNDILQLGKTQEWDPKAMLNNLSFLEQKIHQLQELVHAIVGRRGPVLGRPDELVAQQQQLITADLTSIIIQLISTAGSLLPSVKNSLSSASTPPIRQLGQLGGILNNSGSGIGLDSNLVLPSQGGSKVPDQSNQVDPMDQSAIDNLEDHESKDDEDGDEGENLPPGSFEILQLEKEEILAPHTHFCTICGKGFKRDANLRMHMRGHGDEYKTPAALAKPHKEAGSEMMLIKRYSCPYAGCKRNKDHKKFQPLKTILCVKNHYKRTHCDKSYTCSRCNTKKFSVIADLKTHEKHCGKDKWLCSCGTTFSRKDKLFGHITLFQGHTPAIPFDENKGGLSLQGEHNEDTNKVGNVSFSFGSSTPSSGGVQNIMEDVKGNVDDPSSFFSPLSFEASNFGGFNEFTRSAFDDSEGAFSFLLQASCNYPQKNGGQSSSNNLE

SEQ ID NO: 2027 - protein, 414 aa, Eucalyptus sp.
MPGLTCNACNKEFEDDAEQKLHYKSEWHRYNLKRKVAGVPGVTEALFLARQAALAQEKKKSSQTPMLYSCGICGKGYRSDKAHAQHLQSRSHILRASQGVNLEDGEKTIIRPLAPRVQSRPAPQKESGMAESEDSEDEWEEVDSEDDLVGEAANSLSEMNVDEPSTDHHMEDGSDDDDFCEVDPSCCFICDREHDSIELCMVHMHKQHGFFIPDVEYLKDPEGLLTYLGLKVKRDLMCLYCNERCHPFSSLEAVRKHMTAKSHCKVHFGDGDDDEEAELEEFYDYSSSYVDEDGKQLVASGDMGNSVELGSGGSELVITRRSDGGVSMKTLGSREYLRYYRQKPRPSTGNNAAITAALASRYRSMGLTTTVRSREQMVRLKVIREMNRSGVEAMRTKIGMKSNVIRNLPKNVTH

SEQ ID NO: 2028 - protein, 544 aa, Eucalyptus sp.; identical to SEQ ID NO: 2024

SEQ ID NO: 2029 - protein, 485 aa, Eucalyptus sp.
MDGYAGGHEGSRSDPSPEWPNDSEADTGLEEPMWQLGLGSGGGGGGGGGEGEGEPDLAYPERTEAADCIYYLRTGNCGYGAGCRFNHPRDRSTVMGATRAGGAEYPERAGQPNCQFYMRTGTCKFGASCKYHHPRHGAGSSSPAPLNLCGYPFRQGEKECSFYVKTGRCKFGATCKFHHPQPAGVHVHAPSPPLQVAPPPIPVAPPSSYPAMQSPSVPSSQQYGVVMARPPLVPSYVQGPYGPLLVSPSIFPSWNPYQAPVSPLASSSPQAGSGSSSVYGVTQLSPSAPAFPWPYQPSPSSLGPSVNGRREQSFPVRPGQPECQHYLKTGDCRYGSSCKYHHPPDWNALNVNIVLSPTGLPIQPGAPPCMHFARGECKFGPACKYDHSFGPPSYSPSVSSLGDPFPAGFPFGMLFPSYSSPELRAEIISGPTEDSLPTRSSSTTSMSVTSVGSARASSGPMPSQLPDLSSTNLANCNTKERHSPG

SEQ ID NO: 2030 - protein, 662 aa, Eucalyptus sp.
MDANEATSIVLSKIRGIDPENASKIMGYLLIQDLTEKDLIRLAFGPETLLHSLILKAKTQMGLSSNALPAPSPGPSHPALAPSVSIPTNPPPGALPPQSSPRITPRGADYEVGKGPFSAFAAAAGSVARQNSSPSLPFDGARYFAPLNGGGGGGGGGGGVSAGGGSDFMEDNNQLGDYFAFLNDSSKSGDVFEMGYNADTHLHRRSYSESDAGFGCGGEDACFGGGYRPCLYFARGFCKNGSNCKFLHGDDFEGSVNFVGSPSNFDAEDMMRLKVAHQQRLAAASQFLPGISPTSHGKYMALLMQQHNETQRMGVPGVAMGDDFYKYGRYQVERNEYLAMGLAEKANSASRQIYLTFPADSTFKDEDVSDYFSNYGPVQDVRIPYQQKRMFGFVTFVYPETVKLILTKGNPHFICNSRVLVKPYKEKGKIPEKRQQHQQQLFERGEFSPCSSHSLLDTGEPYDHLARSRVFHNPQEMVIRRKLEEQANLQQAIELQSRRLMNLQLPDLKDDGIYHHLRSFSVGSPLSPRIHPHTQINHKVVMPPDAPNHENAEDCRNSTAATISVIAATGEQQLHHDVNAACGQDVVSGEGKSESSKLTRGDSRGSLENILPDSPFASPTKFSSDHLSDFSKLADATDFTASSGIPDNNVSLTVSSGDGPSH

SEQ ID NO: 2031 - protein, 302 aa, Eucalyptus sp.
MDTRKRGRPEGGSYANGGLKKPKQELESLSGVGSKSKPCTKFFSIAGCPFGEGCHFLHYVPGGYNAVAQMMNLAPAVPQAPRNMAAPPLQNGTGASQPAVKTRMCNKYNTAEGCKFGNKCHFAHGEWELGKPIAPSFDDPRSMGPITGPITSHRLGGRMEPLPPPPGPVSSFGASATAKISVDASLAGAIIGKGGVNSKQICRQTGAKLSIRDHESNPALRNIEFEGTFEQIKQASTMVRELIDNISALTGHSKGHGGPGGPAPPGSNYKTKLCDNFVKGSCTFGERCHFAHGAAELRKTAL

SEQ ID NO: 2032 - protein, 428 aa, Eucalyptus sp.
MDMEGNKRVFQRLSGGPSTASDSRHHPQQQQQQKVCFHWRAGKCTRHPCPFLHRELPAPAQPLSNGGAPKRFAEDSGSQFLRRGPKFTGGSNTWGRVHGSNAVAKKTEKLCNYWVQGNCTYGDKCRYLHSWSLGDCFDMLTQLEGHQKVVTGIAFPSGSGNLYTGSKDETLRVWDCQSGQCAGVINLGGEIGCMISEGPWVFVGLPNLVKAYNTQSNADLSLNGPVGQVYAMVVGNGLLFAGIQDGSILAWKFNAATNGFEPAASLSGHTLGVVSLVVGANRLYSGSMDNSIRVWNLETLQCMQILTDHTSVVMSVLCWDQFLLSCSLDKTIKVWVASDSGNLEVTYTHNEEHGVLHLCGMHDSEVKPVLMCSCNDNCVRAYDLPSFAERGKIFAKNEIRAIEVGPGGLFFTGDGTGQVRVWKWRDSP

SEQ ID NO: 2033 - protein, 298 aa, Eucalyptus sp.; identical to SEQ ID NO: 991

SEQ ID NO: 2034 - protein, 704 aa, Eucalyptus sp.
MSQLTIQTEDTFASLLELAANNDTESFGRCVERDPSSIDEIGYWYGRQKGSKQVVNMQRTPLMVAATYGSVDVMRLILCLSDADVNRTCSTDKSTALHCAASGGAVNAVDAVRLLLSAGADPSLADANGQRPVDVIVVPPKLLSIKFALEELLSTEGSVNEHNLRVSVATSNSTSPPLSSSPDNGSPASANCSSPKNSKLSDAPVLYASEKKEYPVDPSLPDIKNSIYSTDEFRMYSFKVRPCSRAYSHDWTECPFVHPGENARRRDPRKFHYSCVPCPDFRKGACRRGDMCEYAHGVFECWLHPAQYRTRLCKDGTSCARRVCFFAHTEQELRPLYVSTGSAVPSPRSSTSGAAAMDFAAAMSLLPGSPSSVSIMSPSPFTPPMSPSANGISHPSVAWPQQNVPTLHLPGSNLQSSRLRSSLNARDIPQEDFDLLSDYDVQQQQLLNEFSILSQQSMGANSLNRSGRLKTLTPSNLDDLFSAESSSPRYADQALASAVFSPTHKSAVINQFQQQQQSMLSPINTTFSPKSVDHPLLQASFGVQSGRMSPRNMDPISPISSRVSMLAQREKQQQQLRSLSSRELGSNSAAIVGSPVGSWSKWGATNGKPDWAVSADELGKLRRSNSFELGNNGEEPDLSWVQSLVKESPTEMKEKLSSTLSGVPAPATSSEVPSISSQMESVDHEVLGAWLQQMQLDPLVAQQN

SEQ ID NO: 2035 - protein, 150 aa, Eucalyptus sp.
MPLGKYYCDYCDKQFQDTPGARKRHLQGLSHLRAKALWFDSLHHEPNQAYAEGYVRGVCNRFVNTGFCQYGDSCKYFHPKSVSSPAPRTAGGNAQSTVIPGSHLVGGTSLQGNVVVADGTGTATAWGNLPPSLKPPPEGGYPSLPFIDWG

SEQ ID NO: 2036 - protein, 714 aa, Pinus radiata
MDAYEATRIVFSRIQSLDPENASKIMGLLLIQDHGEKEMIRLALGPETLLHSVVLKARKDIILPSNSPSTPSTPSSPSPFMSTNPISISSRPKGSNFSPSSLSNIPSPSSWGGGGGGGGSFSDLSSGDDLINSSSCLYGNGGSDTMIDELQLQDQLSFLNDNSPPLGPNSNPDMFCPQQDLLSSPTAVYGGAAAGWGAPVHRRSCSVSDVCSGSSEDPSCGVGWRPCLYYARGYCKNGISCRFLHSGGLGDAASVVGSPDGSASAVVGSPSKVDMMGQCHEAVLRSKSAQQQRLAAASQLIGSATFPYTPKSMNLLLHHQQNDAHRAAAAAALMMGDDFYKYGRSRLERSDFSVNGCVNPASRQIYLTFPADSTFKEEDVSNYFSNFGPVQDVRIPYQQKRMFGFVTFVYPETVKLILAKGNPHFVCDARVLVKPYKEKGKVPDKFRKQSQLVERGDFSPCGTPTGLDSRGGPFDLNLGARPFYNSQDMLWRRRFEEQADLQQALEYQSQRLMSLQLLDVKKHHHQRALSTGSPIPSPAQSPTLFNNPTFLNIPSVRSLGVTEENGSSPGLSDSQPLNYQSVIVSAGKDLTGSDKSNGNDKESSHTEDKGLAESLEHNLPDSPFASPTKASAEHFSSLTNVVSEAEKDGVGSASSSPNSNNPVSSPLIPGTSAMDMASFTSFNCQIPSHRNVCRCWRANMPSGYIASSSLTEGD

SEQ ID NO: 2037 - protein, 323 aa, Eucalyptus sp.
MSWYVGSSPSREASTISQFGLVPMPKGSSIKMGVPLQHSSGIKQLNVHFQERDLCSTQSTSQSFSEVPNIGGSTDCSQATVLEQTEHGETEGQSVRGQAKSALSMGTQDLVFQPLEVCIPLHYAEPSLGGFMPAAYGPQAMISYPQMAGMIPSRLPLPFDTTQEEPVYVNAKQYHGILRRRQYRAKLGAENKLIKDRKPYLHESRHHHAVRRPRGSGGRFLSKDQKESKFTSLNDESNVKSTARVSSAIDLPNSEVCQLKDHRDTGSTTSCSKTTQTTTSSDAIPVSKFRFFGQPWHVMTTCDPSCDVRYSGDIRHLSLPGER

SEQ ID NO: 2038 - protein, 265 aa, Eucalyptus sp.
MDQTEQTQQQQQQQQVVGVVAGTNQMAYAPPFPTAPVVAPGTPAVPIPSPTQAPSTFPGSPHQLAYQQAQHFHHQQHQQQQQQLQMFWAGQMQEIEQTQDFKNHSLPLARIKKIMKADEDVRMISAEAPVVFAKACEMFILELTLRSWIHTEENKRRTLQKNDIAAAISRTDVFDFLVDIIPRDELKEEGLGVTKATIPVVGSPADIPYYYVPPQHPMGHPSTIMGKPADQAALYAAQQPQPPVSFMPWPHAQSQQTQDDQQTNS

SEQ ID NO: 2039 - protein, 184 aa, Eucalyptus sp.
MVDKSGSNSDREGDNKYNFSGGAATSASNEEASSLREQDRLLPIANVGRIMKQILPPNAKISKEAKETMQECVSEFISFVTGEASDKCHKEKRKTVNGDDIVWALGSLGFDDYAEPLKRYLNRYREVEGERASQNKVTGGESRNEKNLYGDESPEKQLGAASSSPLKFFDVADRSTNGSFSKRY

SEQ ID NO: 2040 - protein, 338 aa, Eucalyptus sp.
MPIRIQNLPKKNFDQGSSLSMPHVGVTYPPWWSLNEQQLPQSLPKNSGLKAESPPMLHHQAKHLGLQLQEQESSSTQSAGNSCHEVSVVGGANSQDQSISSESGQDESCGRSFEGQTKPIFMFNNPEIVFNSSLADQNQPLIRVPYPPVDPYYGGLLTAYRPQAIIQSQVGSQMFGMAPGRVPLPLNLADDGPIYVNAKQYHGILRRRQSRAKMEAQNKLVKARKPYLHESRHLHALNRVRGSGGRFLSTKQRQQLDSASSSHSPFATGPRDRNKDAYEPETHQVGASERQFTSTMAGADFYPDSRFSGISTHMGGAMQCNKGLMRSGAAQHCSSSVR

SEQ ID NO: 2041 - protein, 315 aa, Eucalyptus sp.
MTFKEHEMIHNNPNTQSSSLSFAPWLVLHGSQTPQSESVGRLNSVEHHASEEFHPLSKKATQAVEGSADRPDMTQFAIFSEESKFSIDWRKPQLTMSALPEYGSNFHSEFGPPMMYSKYSNVDQISGLFPLYGAQCQGRIMLPLNLTAEDGPRYVNAKQYQRILTRLKCRAKKKLENFGRARKPYMHKSRHLHAMRRPRGSGGRFLNTKALKNATEVNMKKTGSDGMSPCPTSPQSSEVLQPESRGLNASKVGDNNRTNLTGSEVASLYSPHRLLNNHVRPCVHPHLHVDNGGHDMVMPGKWAPAADSCHDLKVV

SEQ ID NO: 2042 - protein, 288 aa, Eucalyptus sp.
MRKKLDTRFPAARIKKIMQADEDVGKIALAVPVLVSKALELFLQDLCDRTYEITLQRGAKTMNSLHLKHCVQSYNVFDFLREIVSRVPDYGHGHGHSDAVSEDRTVSRRRKATIDDGNDTDEESKKSRMLEMAHTGSSGRGRGRGRGRGRGRGGRATERETAHHETESSEPTTSLQPVNKNIVNQGTVSDHSSEPKKTAEETITATDGSKLGAHGFDLNTQVTENEGTPAKVPVAGVSSEEPNVDEAKHEEYPGWSLSEVDKMSIDPLQLANLGTRIDEDDEDYDEEG

SEQ ID NO: 2043 - protein, 688 aa, Eucalyptus sp.
MTVEDGGNDRFPVGMRVLAVDDDPTCLKVLENLLRSCQYQVTTTNQAIMALKMLRENRDKFDLVISDVNMPDMDGFKLLELVGLEMDLPVIMLSAYGDPKLVMKGITHGACDYLLKPVRMEELKNIWQHVIRRKTSNSKNQSQLPNQDKDNGESGQGAQGAQTTANPDGKLNKRRKDQNEEEEEEDGEDNENENEDPSSQKKPRVVWSVDLHRKFVSAVNQLGLEKAVPKKILDLMNVEGLTRENVASHLQKYRLYLKRISNVQQANMVAAFGAKDPSYMRMTALNGFGDFRTLAGSGRFSGTSLYPQGIMLGRLNSPVGLGLQGIAASGPIQPSHLQNVSKSINSLGKLQPNPPPANQNTSLLQPNHGKPGPHIRDITKFDNPTALKVSPIADNRVTASSSSNLSQSVPSSHLLLQGNPQQSRSGDEFGIQSSFGAVSLQSETLNVGAIGGCNFIDKSRCNENWHGAVQLPQLPSANPTPLTVPFNCSQVAPTNMTEKFTLPSPFIHNGPNNISSSPVPSALGDSRGDMQCQAGLLGNVIQNVDFTSSKSKWEDHNQNYQHQFNHGFGTFDSVVPANGDMEPLIQNMGSASSLRGGSVDAPFAVQSNSGNAPLYQQAEVGKSASMEANMRSFENYLLGQTKFPDGFMPNGFESLDELMDGMIKQEHNEAVLTNGDFSLGTYPVGSCM

SEQ ID NO: 2044 - protein, 518 aa, Eucalyptus sp.
MDCLELNLNKEIGDGTSGGGGVGGSVGKNANKSGGGEGFIDRSKVRILLCDNDTKSSEEVLTLLLKCSYQVMSAQDEVSIVVKCLRLGAADYLVKPLRTNELLNLWTHMWRRRRMLGLVEKNILSYDFDLIGSDPSDNNTNSTTLLSDDTDDKSRKNTNPEIGLSATHEDESAAVAEPPLRGAVNCRPNVPGISDRRTGPCSSGPKKSELKVGESSAFFTYVKSTIVKNTPSTAGQVDGCASVNYRMEEKNQAEDEQAVYDPQAHENGEVWEKSSLGDEFPSGSSVPDSLSLERSCTPPGSADFPQQRNFMEERAPQMPIHATNEPRVDLPGLPAQSTYPYYVPGVVNPVMVHSSAQAYQNNLHDLQNHPTSAMLPQYSHLPHFPTHVNGMASFPYYPVGLCLQQGLMSSPHSWPSFGGSSISEAKTNKVDRREAALLKFRQKRKERCFDKKIRYVNRKRLAERRPRVRGQFVRKVNGVNVDLNGQPESADYDEDEAEYEDEDLASRGSTPDAEISGT

SEQ ID NO: 2045 - protein, 777 aa, Eucalyptus sp.
MPIVQMTNNRPGTEGLAEQNHHKNDDNKDIRDGVRGDGQELAEEDELQIYGDVEGASDRKVEATEPQDFVHAHSVIPRSQQQSEEPSVHWERFLPLRSLKVLLVENDDSTRQVVGALLRNCGYEVTAAANGLQAWKILEDLTNRIDLVLTEVVMPCVTGIGLLCKIMSHKTWKNVPVIMMSSHDSMNIVFQCLSKGAVDFLVKPIRKNELKNLWQHVWRKCHSSSGSGSESGIRTQKSTKSKSCEDSDNNMGSNDEDDSESIGVRDGSDNGSGTQSSWTKRAVEIDSPRKASSWEQLADPPDSTCAQVIHARPDTRSSNWVPMTAMRNAKGKYDELDKDMMGKDLEIGAPDLQIEEPSKNDKITADPTANEIAEIEYQKNDEQLGDKQLELNGEKLNAKTGAVTSSSNPPMERVNFDIANGSSKMSDMKDKAAYDIKEMPSLELSLKRMKDDVESKSHDKKILRHSDLSAFSRYNSSTPNQTPTGNVSSCSPADNSSEVDKTEYVQNFQSNSSSPQLNQGSNGSSNYNDVGSTTNNAFMKLENVTDKPPSKSILKYLHQSSAFQPVQHGGACPQPTVQGKVDPAMAHVIMTQARGVKHRVQVQHHHHHYHLHHHHHAQNVTQMQEPAEDHDNASKSTAAAAPQCGSSNILSTPYEGIVTNNSCNGSASGSNHASNGQNGGNFPTNDQETNVDGDNTIPCESGANGGIGYTNRNGVEQSRNAQREAALNKFRQKRKERCFEKKVRYHSRKKLAEQRPRVRGQFVRQAVNEIKDEEADS

SEQ ID NO: 2046 - protein, 333 aa, Eucalyptus sp.
MSESDDLRHGRGGGSGDGELDGEDSVAEWEFGLPSCDDLAPLSQALIPPDLASAFSIALRPSRTAGDVNRASRSTLTGLRRCGSTASSQGFSTNDNFKSFVDDRQSMEVEVEEEEKEEEEEEEEEDGADKSDSRKSRRIETAEEVDSTPRMDDSQEDPSEKTSKRPRLVWTPQLHKRFVDVVAHLGIKNAVPKTIMQLMNVEGLTRENVASHLQKYRVYLRRMQGMSSEGLSSSDQLFTSTPVVHSLNYVAGSTGHGDGQMPMPTPVPYGEQPPMMPMPVYAMGHGYGHMRMQIGDLSGFESNQYVTQQRDWSSNKYGSVASYQQTASNEKRF

SEQ ID NO: 2047 - protein, 572 aa, Eucalyptus sp.
MMESSKGFSSPRSNGFPAGLRVLVVDDDPTWLKILEKMLKKCSYEVTTCGLARDALKLLRERKGGYDIVISDVNMPDMDGFKLLELVGLEMDLPVIMMSVDGETSRVKKGVQHGACDYLLKPIRMKELRNIWQHVFRKRIHEIKDIESHDGLEDLQVTKSGYDWVDDGHFFSGEDMLTPGKKRKDLENKHDEKDLTDPSSSTKKARVVWSVDLHQKFVRAVNQIGYDKVGPKKILDLMNVPWLTRENVASHLQKYRLYLSRLQKENDMRSSYGGMKHSDLNPQDAARASSHQNSINFQQNDATNGNSKFAGNNLLIQNLNSKNNEIDTRGTIITEQSGPGISHSLPPLEQEMKFTAFDGITPRSYPWREVPEIQFHQENAGNQPEDCFGHVAGPIGGLQNHVQVDELLPITSISSRAQLPNPIETKPLNVDYAINSFTQASPVKTRIDSFPLPTKSHMGNQQAIQPPSINTPIMESQGFNPSCITDLESSRRNFSSTPTESPFTSPDEILQVGWLQDYSTCLGLQNIEFPDFGDPTIIPGVPVHLYTALKFDYDQPSDQSELPVINQGLFIA

SEQ ID NO: 2048 - protein, 164 aa, Eucalyptus sp.
MPRFHGQSNHAPVDIVNQLQKQYVDYLSSLFHEGVLDDQFTQLQKLQDESNPDFTVEVATLFFVDSDKLINNMAAALERSPVDFKQVDADVHQLKGSSSSIGAMRVKNLCITFRSFCETQNYEGCLICLQQVKNECAVLKDKLQNLFRMEQQIVGAGGSVPLMD

SEQ ID NO: 2049 - protein, 351 aa, Eucalyptus sp.
MELSLDLSLAREPRPVSEFFREVSGIPDRDERLSKLDDYVARLEEEMGKIDPFKRELPLCMLVLNDAMERLKEERLQCKEMEFIRPNRNSDKDKRAEVENKDSCDQRKWMSSPDQNLDQYAAEKNPIEPCSYKKKGGAFLPFGLHRAPPKEGKDSSPISRLTLSTPGSMLASPDNDNIKKLSFEAPFSTDHEKLQKSPQQAQQHRLQQHQLRKQRRCWSPELHRRFVEALEQLGGAQVATPKQIRELMQVEGLTNDEVKSHLQKYRLHVRRIPSPSAAVENGLSLVQERSGVDHSELRTSESDSPQGPLLACASARAASSAGGGSAEMTDEEENSEGHSWITVLGEKITAH

SEQ ID NO: 2050 - protein, 775 aa, Eucalyptus sp.
MPIVQMTNNRPGTEGLAEQNHHKNDDNKDIRDGIRGDGQELAEEDELQIYGDVEGASDRKVEATEPQDFVHAHSVIPRSQQQSEEPSVHWERFLPLRSLKVLLVENDDSTRQVVGALLRNCGYEVTAAANGLQAWKILEDLTNRIDLVLTEVVMPCVTGIGLLCKIMSHKTWKNVPVIMMSSHDSMNIVFQCLSKGAVDFLVKPIRKNELKNLWQHVWRKCHSSSGSGSESGIRTQKSTKSKSCEDSDNNTGSNDEDDSESIGVRDGSDNGSGTQSSWTKRAVEIDSPRKASSWEQLADPPDSTCAQVIHARPDTRSSNWVPMTAMRNAKGKYDELDMMGKDLEIGAPDLQIEEPSKNDKITADPTANEIAEIEYQKNDEQLGDKQLELNSEKLNAKAGAVTSSSNPPMERVNFDIANGSSKMSDMKDKAAYDIKEMPSLELSLKRMKDDVESKSHDKKILRHSDLSAFSRYNSSTPNQTPTGNVSSCSPADNSSEVDKTEYVQNFQSNSSSPQLNQGSNGSSNYNDVGSTTNNAFMKLENVTDKPPSKSILKYLHQSSAFQPVQHGGACPQPTVQGKVDPAMAHVIMTQARGVKHRVQVQHHHHHYHLHHHHHAQNVTQMQEPAEDHDNASKSTAAAAPQCGSSNILSTPYEGIVTNNSCNGSASGSNHASNGQNGGNFPTNDQETNVDGDNTIPCESGANGGIGYTNRNGVEQSRNAQREAALNKFRQKRKERCFEKKVRYHSRKKLAEQRPRVRGQFVRQAVNEIKDEEADS

SEQ ID NO: 2051 - protein, 289 aa, Eucalyptus sp.
MGSCGRSGTVRQYVRSKVPRLRWTPELHQCFVHAIQRLGGQDKATPKLVLQLMDVRGLTISHVKSHLQMYRSMRSDLGRSDRGCGQQKRRAAEDDDPDRDGGCVEEVNDDEGPPHAFAKPVHHSRFACSSPPCKRSRTEKVATTTTTTSAVAEQAPYGFEVGGVDGFRWHTPCMPRDLHSFNDPLECAAKEESKFPLIAKLQDRMQMPRKGLKLTDWRSFPLEEYEVSQGCELSLSLSLQCHSIHRSNGSSTSEISEAFSSCSRSRECSGPCSDKSSVNLDLSIALCGS

SEQ ID NO: 2052 - protein, 259 aa, Eucalyptus sp.
MELTSDVEDTQQQQQLPEGGGGDKKQEEEVGQHFHVLAVDDSHVERKLLERLLKDSSYEVTCVDSGDKALRYLGLLDDHTNLHAQDGFDNSSAAASASSSLLQPSLQEGTKVNLIMTDFCMPGMSGYDLLRRVKGSYWKDVPVVVMSSENVPSRINRCLEGGADEFLLKPVQLSDLEKLQPYILKSLNNPCEDIKGDGIDDSEDDEIETRNYGEDNTNKCNSNTNNVAKRKAMSAEPTDRRPKIKGLAVVYNKNQELIG

SEQ ID NO: 2053 - protein, 770 aa, Eucalyptus sp.
MFMDPQYAGYSGPFSGFNFHDQTLAPFSNPYEELANHLLLDDPESDLSVHFPSFASDPEPCNSAVSPSFSVDGDFLSDYGDTSDPTLKYINQMLMEEDIDDKPCMFHDPLALQAAEKSLYDALCPKDRPSQNQSPLYMDSPDDNCSGSSNGYCGSSTITSSTASGGNSVDFPGTGDYCESRPSIFQPHIPENFVFQATAIPSRQSGHEFRKNVITKAKGMLGSGSAMGEFMLPNLFADSNSMLFFQKGFEEASRFIPKGNPLSIDTEKRMPHLVSKRETARAAVKAENSEPELSYLYEIKGNKKHEREDAEFEYQRSTKQPAVCVEENELADIFDRVLLCAPTGNKPDSKSPGSRFEDASNNGASQNVQKNLQSPALSAEQLCVKKPMSDKKEVVDLRNLLCSCAQAVAVEDRKNANQYLKQIRQHSSPFGDGSQRLAHSFAEALKARMDCTGAQVYTELGSKRKSATEMLKAYRAYLSVFPFQRFAIIYSNHMILSISEKATKLHIIDFGILYGFQWPALIHCLARRPGGPPKLRITGIELPQSGFRPAERVQETGRRLAKYCERFKVPFEYNAIAQKWETIRIEDLKISKDEVVAVNCLFRFKNLLDETVIINSPRDQVLKLVHRIRPRIFVHSILNGSFNACFFVSRFREVLFHYSALFDAFDAKLPREHPMRLVFEREFFSREALNVIACEGTERVERPETYKQWQIRNTRAGFKPLPLDPVIMKKLKSKLKEGYLDDFVVDKDGQWMLQGWKGRILYASSCWEPV

SEQ ID NO: 2054 - protein, 648 aa, Eucalyptus sp.
MSSGFSGGSGGGGPEFYTAAGGMSARSIASAMSSVNGNAASQSPFRSQPQFGAGIFLEPNSQMAPQPAQPQPGLVGKRTLMEFQAQQQQQQHQHQHQHNQALSNLILRSVRSKISPRSSPISHLDFSAAVSSPDVMSSLSALSSPAGFSAQRYGLPILQQLRPQPIHLGNGAIHVSNQALGGVSFANVLQNRANPHQAEPENKMMNRLQELEKQLLDDDEEGDGDAVSVITNANSEWSETIQSLISPGQKQISPSPTSSSSSSSPSSSLSVPSPVPICSRQSLMEAATAIYEGRVDVASEILTRLSAVPNPKGNSEPKLMEYMLSALKSRVSPADNPPPVAELFTKDHVSSTQSLYELSPCFKLGFMAANLMILEAASEQPSTNKLHVIDFDVGQEGQYINLLHALSTRQPGIPSILKITTLADGFNGEERLRMVRDRLSELAAQIGVRLVFNIVSQKVSELSRDSLGCEPDEVLAVNLAFKLYRMPDESVSMENPRDELLRRVKGLAPRVVTLVEQEMNGNTAPFATRAGEALGYYGALLESLESTVPRDSSDRGRAEEGLSRKLGNSVACEGRDRVERCEVFGKWRARMGMAGFELKPLGQHVAESMKARLESGNRVNPGFTVKEENGGVCFGWLGRTLTVASAWR

SEQ ID NO: 2055 - protein, 572 aa, Eucalyptus sp.
MESHPLYRYSETGAGLSFTSSHPTVPSLPNRLFGHSKFEIRESPISPFSTNFDCETLTVLSDNQEQYSSTDNYSGVSSSYNSSLETTSGFQRSSPSQDGCRDSLLSCSGRPTSLQNEHHSQNTAYTLQELEDVLMDDGQEVRVTDTSIGEHVWDQNPRGSQFSCPEDSVAFIQSQSGKSVHAEKHKEAIEELLVQDVPPGDLKQLLIACAKSLSDNDMHKFEKLIEKARRAVSISGEPIQRLGAYMIEGLVARKEESGSNIYHTLRCREPEGKDLLSYMHILYEICPYLKFGYMAANGAIAEACKNEDRIHIIDFQIAQGTQWTTLLQALAARPSGPPYVRITGIDDPVNRYARGAGLEAVAGRLAVISEKFKIPVEFNGLPEFAPDVTRDMLDVRPGEALAVNFPLQLHHTPDESVDITNPRDGLLRMVKSLSPKVITLIEQESNTNTTPFLTRFVETLDYYLAMFESIDVTLPRDRKERINVEQHCLARDIVNIIACEGKERVERHELFGKWKSRLTMAGFRQYPLSSYVNSVIRNLLRYYSENYTLVEKDGGMLLGWKDRFLVSASAWY

SEQ ID NO: 2056 - protein, 545 aa, Eucalyptus sp.
MPSFQKQHSSASVLSFYQQPPQMIEPRYLSNYEQIDGGMNRGLAGQGFDSSFQNYDEQIFTLDSSTSASGLASYDSGSNISTSPDGTPFVKSFHSDQHLSVENVSGSPLSVSSITDYGNDELRDKLRELEMSLLGPESDIRDYQSSCFKNSSHNIFPTSMWHSSRVRDMMPKPDLKQVVIACARAISDADTSSAAALMDMLEQMVSVMGDPIQRLGAYLLEGLRAKLKFSGSIIYRKLKCEEPTSSELLTNMQVLYQICPYWKFAYVSTNVIITKAMENEQRIHIVDFQITQGSQWVTFIQALAQRPGGPPLLRITGIDDSDSVHARGAGLEIVGQKLSEIAESCNVPFEFHDAAVSLSEVELQNLMIRPGDALAVNCPYILHHIPDESVSTQNHRDRVLRLIKSLSPRVVTLVEQESNTNTSSFFPRFIETFDYYKAMFESIDVARPRNDKQRISAEQNCVARDIVNMVACDGPERMERHELFGKWRSRFQMAGFNQLPVDASVTRAVLDMLKQYHGNYRIEEREGALYLGWINRAMSTLSVWR

SEQ ID NO: 2057 - protein, 789 aa, Eucalyptus sp.
MESNFTGFTHAADDFETNSLAHPANSDHPSNLLDGFDINNLYVDFNSTEITSLLYQTEPAYDNPSAAVNLDGDFDFPSTDVSSKDASLQHSTISNGSPSQGGESFSPPSDYSNSTDPVLRYIHQMLEEENVEEQPWISPDDFALQDTEKSLYDLLSENSTFSPEPAVQFDINQFIDSPSSNSYENSSDQGGDGTTDTRTNCSQFSGPNSPDNPEGKNQAVLQGPYPGNGVLPSNMGTSSQLHTNPMSSLQHQDEFSDSFPSDLLVSNMFSNSNSILQFNKGLEEARKFLPSSIQLTINQEDYKSAPNVREPGENGTDDGKSVKSRSESGSWGRKNHERDDESFEEGRANKQSASYTEDGELSEMLDKVLLGCGLGGQMSGCTPENMSQSKGPPGPKGGRVRRKKGNKSTADLRSLLILCAQAVSANDFRTAYELLKQIRQDSSASGDGSQRLAHYFANGLEARLAGSAGDRQTFFYSSELQKRTVADKLKAYQLHLSACPFKKLPILFANVVLLKIAATAKVLHIIDFGISFGFQWPILIQELSKRDGGPPELRITGIEIPQSGFRPAERIEETGRRLAKYCERFKVPFEFHAIPSRNWECIRVEDLKIQSGEIVAVNCLSRFKNLYDETVEVDCPRDAVLRLIRSIKPDVFVHGISNGSYNAPFFLTRFREALFHLSAIYDMLDATVPSDNDQRVVVEREFYGREIMNVVACEGLERIERPETYKQWQVRVARAGFTQLPLDQEVMEMARTKMSRHYPKDFVLAEESKWMLLGWRGRIISACTCWVPI

SEQ ID NO: 2058 - protein, 720 aa, Eucalyptus sp.
MDRPPDKLDNFIDGYVLVDGDDAAFSILREDDLVSELTIDDTFNDFTYSCTCAPHLGADLGKEPAEDYDFSDAALKYINQMLMEEDIEEKSVACHEASAIEAAEKSFYEVIGERYPPAADQHPSPNQTNESSCGGSDSVIKLVESEPNYESEEHTVLTTVSQSISSSVAQSLDDVRVGISTAGHAESPVNAISLSELIGSESVMQFKGNSEETRESLAFGNEILVDPERGEFSFNEQTEEPTSLVPNEETDENMFANLGGNRGKKNPLQEDVNLEVGRMSKYLSVYTESTVRSEIFDMVLLNPKESEATLREALRNMMQNGKSKVPNEGKAHGKKQGRRKRDVVDLRTLLTLCAQAVTMDDRGSAGELLKQIRRHASPTGDGMQRMAHYFANGLQARLAGSGSQIFKALMARPRSAVDVLKAYHLLLTICPFMKLSHYFSNKTILNVAREAPKLHIIDFGILYGFQWPGLIERLSSSPSGPPELRITLIDLPQPGFKPDEIVEETGRRLVSYAKTFNVPFKFNTIVKGWDAIKVEELNIHSDEILVVNCIHRFHNILDDTVLAESPRDVVLNLIKKMNPDVFIQAVVNGNHGVPFFVSRFREALFHFSAVFDILEATVPRDDPERLLLEQEILGKQAMNVIACEGSDRIERPETYKSSHVRNLRAGFRQLPLDKDVVSLAKDKLKSCYHKDFEIEEDGQWLLQGWKGRIIYALSTWRPDC

SEQ ID NO: 2059 - protein, 579 aa, Eucalyptus sp.
MELHQLFGCGLTDAGLWCSSSHPAVTSISNRSLKSLKFDIGSSPCLPFSSQVESEALPPPRDIREQQSSAENLSISGASRNHTLETNSSLVCSKSDFCVDPLSDRLTSCSDLTSLSGSLNSSPRMKFAAKELEATFNDVVTSPYVSYWKGSIPLVQGQKPNRRSQECYRLRSIQPQASVASRHSQFNELEKWHKAIDELLVRSPPEDKTRHLLIECAKALSENDTEKFDKLIKKAWNAASIHGGQVWHLGSYLVEGLMARRKSLGTTVFHVPKCEEPQSKDWLTYMHVLYEICPYLKFGYMAANGAIADACRDADRIHIIDFQIAQGTQWVTLLQALAARPGGAPRVRITGIDDPVLRYTRRVGSEEVGRMLAVVSEQFKIPVEFRGLSVSSPDVTRDMLDIRPGEALAVNFPLQLYRTPDESVDTNNPRDGLLRMVKSLSPKVITLIEQESNTNTSPFLSRFVETLDYYSAMFESIDMALPRDGNDQIDPVRHCLKRDIINIIACEGKERVGRHELFGKWRSRLQMAGFSQYPLNAHVNSVIGTLLRRYSENFTAEEKEGAMLLGWKQRSLISVSAWH

SEQ ID NO: 2060 - protein, 539 aa, Eucalyptus sp.
MSLIRSTELSATPYASSEMLGSKKHQMMYVSETYSGEDYDPKYFIDSPSEETINPSSYGMSRNLYHTQGSSINTENPFSTSESELMDGQSLDCVEYTEDKMRLKLQELERALLDDGADEEEDNMYVDGQWVDQLQINSHDSPKESSSSDSNLSSISTNREVSQPPSRTPKQLLLDCATAISEGNIREASIIIDRVRQIVSIQGDPPQRIAAYMVEGLAARMGASGKFLYKALKCKEPPSSDRLAAMQILFEVCPCFRFGFMAANGAIIEAFRGEKRVHIVDFDISQGSQYITLLQTLASLPGQRPYLRLTGVDDPESVQRPIGGLKNIGQRLEKLAEALNIPFEFRAVASRTPLVTPGMLDLQPREALVVNFAFQLHHMPDESVSMINERDQLLRMVKSLNPKLVTVVEQNVNTNTAPFLVRFGEAYSYYSAVFDSLDATLPRESQDRVNVERQCLARDIINVVACEGEERIERYEVAGKWRARMMMAGFASCPMSKSVTESIINLIRQYSERYKIKDDMGALHFGWEEKSLIVASAWR

SEQ ID NO: 2061 - protein, 763 aa, Eucalyptus sp.
MIMEPRVTRFSGSLSAFKLDDETLLPFSDQRANFANGFDRAGPSPDLGFAHKPFFPSDPRYCDSAPSSLVSAEADLPSDDSDFSETVFRYINHMLLEEDMEENPSTFHDPLALQAAEKSLYEALSDPYPSEANSSPPFMDSPDNNYSGNSSDYGKSSPSSNTSGSNFADHQWLGDLGDGRNNLPRSSVTGDFIFQSTVNAHVQPSFSSRNSFLSNGNRTKASLGSGPLFLNFSTESQSVLQFQRGVEEASKFLPQGTQLFIDLEKSSVNSWFKERKSLNVVKVEKDESDLLPLNGISGKKNHQREDSEFEDERSNKQTAVYVDDTELSEMMDKLLVCHIKGKSRDSNADESSKKEVSKSLQQNRQTHTADGGKFHNKKPTPTSNMTEMVDLRTLLILCAQAVSSDDRRTANDYLRQIRQHASPSGDGSQRLAHYFANGLEARLEGTGSQVYAALGSKKTSAVDLLKAYHVYRTAFPFQRVANMFVGDMIMHLAEKATTLHIIDFGISNGFQWPAFISRLSRRTGGPPKLRITGIELPQRGFRPAEKVQETGRHLAQFCKRFNVPFEYNAIAQKWDTIKIGDIKIRNGETIVVNTMFRFKNLLDETVVLNNPRDSVLNLIRKIRPHLFVQAIVNGSFGAPFFVTRFREALFHYSALFDAFDTNLGRDNQMRLLYEKEFFGREAINVIACEGTERVERPETYKQWQIRNMRAGFKQLPLGPAVMKRLRSKLEQFHDDFVVDEDGQWMLQGWKGRILFASSWWVPI

SEQ ID NO: 2062 - protein, 733 aa, Eucalyptus sp.
MIMEPRVTRFSGSLSAFKLDDETLLPFSDQRANFANGFDRAGPSPDLGFAHKPFFPSDPRYCDSAPSSLVSAEADLPSDDSDFSETVFRYINHMLLEEDMEENPSTFHDPLALQAAEKSLYEALSEPYPSEANSSPPFMDSPDNNYSGNSSDYGKSSPSSNTSGSNFADHQWLGDLGDGRNNLPRSSVTGDFIFQSTVNAHVQPSFSSRNSFLSNGNRTKASLGSGPLFLNFSTESQSVLQFQRGVEEASKFLPQGTQLFIDLEKSSVNSWFKERKSLNVVKVEKDESDLLPLNGISGKKNHQREDSEFEDERSNKQTAVYVDDTELSEMMDKLLVCHIKGKSRDSNADESSKKEVSKSLQQNRQTHTADGGKFHNKKPTPTSNMTEMVDLRTLLILCAQAVSSDDRRTANDYLRQIRQHASPSGDGSQRLAHYFANGLEARLEGTGSQVYAALGSKKTSAVDLLKAYHVYRTAFPFQRVANMFVGDMIMHLAEKATTLHIIDFGISNGFQWPAFISRLSRRTGGPPKLRITGIELPQRGFRPAEKVQETGRHLAQFCKRFNVPFEYNAIAQKWDTIKIGDIKIRNGETIVVNTMFRFKNLLDETVVLNNPRDSVLNLIRKIRPHLFVQAIVNGSFGAPFFVTRFREALFHYSALFDAFDTNLGRDNQMRLLYEKEFFGREAINVIACEGTERVERPETYKQWQIRNMRAGFKQLPLGPAVMKRLRSKLGAVP

SEQ ID NO: 2063 - protein, 548 aa, Eucalyptus sp.
MQTSHNRQNSASIHGLYHQPVQDIDPYCSSNFQIMENNVSPDIGSQGTNFSIQGYDGQYFTLDSAPAVSSFGSYDSPSAVSVASNRSPFSTQGSHSYVSDAQHSSDYLYGSPISGSSVANGGPQMWDKLRELENSLLGPESDISDSCNCCLNSGSHQFPSTGQWNVNQMIEMIPKLDLKDMLIFCAQAVAEADMPKTAALMEVLERMVSVSGDPIQRLGAYLLEGLRARLESSGSIIYRKLKCKEPTGSELMSYMSILYQICPYWKFAYESANVVIGEAIKYESRIHIIDFQIAQGSQWIPIIQGLAGRTGGPPLIRITGVDDSQSAHARGGGLDIVGKRLEKVAELCGVPFEFHAAAMCGSQVEREDLRVRPGEAIAVNFPFVLHHMPDESVSTDNHRDRLLRLVKSLSPKVVTLVEQESKTNTSPFYTRFIETLDYYTAMFESIDVACRRDDKQRISAEQHCVARDIVNMIACEETERVERHELLGKWRSRFRMAGFQQFPLSSAVTDAVRNLLREYNENYRIEEKDGALYLWWRNRAMATSSAWW

SEQ ID NO: 2064 - protein, 790 aa, Eucalyptus sp.
MDPLFFDSSACIKVDDRPIDSHAFSPSPDRYPSLTDGFFLDDPFLDLKSSDSAFLSNKVDPANDLSSKSIDLGIGDLMFPSTSGISDGGPFGPSLSLRSALPPLGDTDSSDPVLKYISQMLLEENMEEQPWEFADQVALQNAEKSLYNALGQQHSEVSDQSPSQLDLSHYIKSPTSSLSGSSSACGSRDATSVTVSSSDSAVANILYTIKEHNHAVQENSDLDFQSNVDSSSRLLSNSSSSITNYDDGSEESLHELLVKSIFSDSESMVQLKKGLEEASKFLPTNSQLGINPEDSKPPLETEKGTPRMLINEEINVRCLSDGFKGFRNHERDEDAFEEGRANKQTALYTEESEFSDLFDRVLLCNENGEAMCSGDKSVETGLSKDIRPQRKKRGSNRGRGRGKKQGSENTVDLSTLLILCAQAISTSDFRTANKLLKQIRENSSPSGDGSQRLAHYFANGLEARLVGNETQTQHFYSSLVARTTSAADILKAYHLHISTCPFVKLSICFGNYMILRLAEKATTLHIIDFGIGFGFQWPILIQKLSSRSEGPCKLRITGIELPQAGFRPSERLEETGCRLERYCERFNVPFEFNCIASKNWESIKLEDLKIQSNETVAVNSSSRFGNLLDETVGDNCPRDAVLNLIWQIKPDIFVHVVSNGYHNAPFFVTRFRKALFHLSAVYDMFDAILDGDSNERLVIEREFHGREIMNVVACEGSERVQRPETYKQWQVRHIRAGFKAIPLDQELMTLFRGKMKECYHKDFVFNDDGYWMLQGWRGRILYGASCWVPT

SEQ ID NO: 2065 - protein, 158 aa, Eucalyptus sp.
MKGGKAKAETTRVDASLKRKGAGTQRAGKKTAKKEKAVKDPNKPKRPASAFFIFMEDFRVQYKQKHPNNKSVAAVGKAGGDKWKSMSEAEKAPFAAKAEKRKDEYNKKMNAYNKKSAEGTNGADDEESDKSKSEVNDEDDEDGDDSAEVSARCCRWFK

SEQ ID NO: 2066 - protein, 172 aa, Eucalyptus sp.; identical to SEQ ID NO: 1045

SEQ ID NO: 2067 - protein, 837 aa, Eucalyptus sp.; identical to SEQ ID NO: 1078

SEQ ID NO: 2068 - protein, 264 aa, Eucalyptus sp.
MGIDDLCNTGLVLSLGLGTPFKIEAQRQAKQRLNFEPSLTLCLSGTTKATRDEQPPADHLYRQASPHSHNSLSAVSSFSSPRVKRERDLSSEEAEVETRVSSKASDEDDDGANARKKLRLTKEQSALLEESFKQHSTLNPKQKQALARQLNLRPRQVEVWFQNRRARTKLKQTEVDCEFLKKCCETLTDENRRLQKELQELKALKLAQPFYMHMPAATLTMCPSCERIGAGPSVDGAAPTKGPFSMTTKSHLYSHHFTNPSAAC

SEQ ID NO: 2069 - protein, 359 aa, Eucalyptus sp.
MEEYGQMNENSSTGSRGNNSFLYASPVLGPSSSGNSNYGRGNSSGGHFYSQSGDHCFQSEAPPHPVVKTEATTSHHGHAQKFHHYSLVRDHHDPSASHHHHHQHHQHQQLQTASESSREVDAMKAKIIAHPQYSNLLEAYMDCQKVGAPPEVVAKLSVARQEFESRQRSSVASADGSKDPELDQFMEAYYDMLVKYRDELTRPLQEAMDFMRRIETQLNLLSNNGPVRVFNSDEKCEGVGSSEEDQDNSGGETELPEIDPRAEDRELKNHLLRKYSGYLSSLKQELSKKKKKGKLPKEARQKLLSWWELHYKWPYPSETEKVALAESTGLDQKQINNWFINHVIECWVKSMATQCKKYF

SEQ ID NO: 2070 - protein, 315 aa, Eucalyptus sp.
MGERDDLGLSLSLSFPQSHLHQQQQQQQQQQRQSLQLNLMPSLVPSSASSAQSGFNLQKRSCNDAFPSSSDRNSEARSFLRGIDVNREPSAGAAADYGEDEAGVSSPNSMASTVSGKRSERDHQSQTNGDDLDNERASSRGGGSDEEDGDMSRKKLRLSKDQSAVLEESFKEHNTLNPKQKLALAKQLGLRPRQVEVWFQNRRARTKLKQTEVDCEYLKRCCESLTEENRRLQKEVQELRALKLSPQFYMHLSPPTTLTMCPSCERVAAPSPPSAVGRPLAAVPAHPRPVPLINPWAPAAAPLAHAPFDALRSCS

SEQ ID NO: 2071 - protein, 738 aa, Eucalyptus sp.
MFQPNMFDSHHHLLDITGARSSESEVLKMREIEDFETKSGTETMEPDPSGDDVQDPNNDDNSNNNGQRQKRKRYHRHTQRQIQELEAFFKESPHPDDKQRKELSRELGLEPLQVKFWFQNKRTQMKAQHERHENAILKAENEKLRAENMRYREALSTATCPNCGGPAALGEMSFDEQHLRIENARLKEEIDRISVIASKYVGKPLASNYPHLPPHMSSRSPDQFPAQSGLVGEMYGGIDLRRSVSMPSEADKPLIVELAVAAMEELIRMAQGGEPLWIPAGSGQPSEILNEDEYFRIFPRGIGPKPLGFKSEASRESAVVIMNHINLVEILMDEHQWSGVFCGIVSRAMTIEVLSTGVAGNYNGALQVMTAEFQVPSPLVPSRENYFVRYCKQHGDGTWAVVDVSLDNIRGNPILRSRRRPSGCLIQELPNGYSKVTWVEHVEVDDRAVHSIYRPLVNCGLAFGAKRWVATLDRQCERLASSMANNIPSGDLLITSPEGRRSMLKLAERMVLSFCSGVGASTAHAWTTLSATGSDNNVRVMTRKSMDEPGRPPGIVLSAATSFWLPVPPKRVFDFLRDENSRNEWDILSNGGQVQEMAHIANGRDPGNSVSLLRVNNANSSQSNMLILQESCTDSVGAYVIYAPVDIVAMNVVLNGGDPDYVALLPSGFAILPDGPEFCGGGGILEIGSGGSLLTVAFQILVDTVPSAKLSLGSVATVNNLIKCTVERIKASVSCDNP

SEQ ID NO: 2072 - protein, 357 aa, Eucalyptus sp.
MAYNHGQMPQEQVPFHHYSDQGGHHQGRDGVHKFFSASILRPQNFLRLDSEPSAHADDASAAAAAASYNNDDGAGEEEMVEDDDGGGGGGDYESARHKAEILSHPLYEQLLNAHVSCLKIATPVDQLPRIDAQLTQSQRVVAKYSVLGNGGVVDGKELDQFMTHYVLLLCSFKEQLQQHVRVHAMEAVMACWELEQALQSLTGVSPGEGTGATMSDDDEDQDDSDAKLFDGSFDGHDSMGFGPLVPTESERSLMERVRQELKHELKQGYKEKIVDIREEILRKRRAGKLPGDTTSLLKAWWQTHSKWPYPTEEDKARLVQETGLQLKQINNWFINQRKRNWHSNPSSSTVPKSKRKR

SEQ ID NO: 2073 - protein, 669 aa, Eucalyptus sp.
MSTYYTSSSDQRDAAPVLYLREHAPTSHAEEPLLPGNNMTYVTSGFFSSALTGNPQQQSNGMDMLSVGGLDTMPQHQAMFSGLGGSQMSDHGLAGWRDGRNEMLFMQPMASHSTVQDGQNMQGQGLSLSLGTHIPSGIHIPSSQYRSQNLGLTAFLSPNSSKSAESNSRNGSTVDEQPRSAEFFPQSLVGANQDLNTGNFSVNGMSNMSRMLSNSRYLRAAQQLLDEVVNVRKALKQSDSEKIKKSEEGDEDSKKDVVSNPQESDGNSAGDLSQAERQELQSKLAKLSSMLDEVDRRYKQYYYQMQIVVSSFDVIAGPGAAKPYTALALQTISRHFRCLRDAISTQIQATRKSLGEQDASGSSKGVGIPRLRFLDQQLRQQRALQQLGMMQQHAWRPQRGLPESSVSILRAWLFEHFLHPYPKDSDKILLARQTGLTRSQVSNWFINARVRLWKPMVEEMYKEEIGDAEMDSNSSSDTAKPKTGDIKSSMEDRVEEVQQSSTATQRCSSGQLMDSSFDRTPDVEMAGHSVGFNYLNGRHRDVEAEYGQMKLNGEQAGVDDCGLFQNSMVQSGSNNDRFMAAAAAYQMAELGRFGGGSGVSLTLGLQHCEGGTLPVSTGAHSGFLAMRGDDMYNQAASSIGTETTEFESINIGNQQQRFGSTQLLHDFVA

SEQ ID NO: 2074 - protein, 314 aa, Eucalyptus sp.
MEWEKQEQHHPHHHHHPHHHAHQQQHHHQQQQPQQQQQAKEAQQQQGGEGMGNGTAAGNGGGVLYVKVMTDEQLETLRKQIAVYASICEQLVEMHKNLTAQQDLAGVRLGNLYCDPLMTTGGHKITARQRWTPTPLQLQILERIFNEGNGTPSKQKIKEITTELSQHGQISETNVYNWFQNRRARSKRKMQNATGNNTESEAEAEVESPKEMKTKPEIFQSQQNPVSRNEDLCFQSPEISSDLHFADSQTKVESMVYPDGSLRSRNRNLGQLSFYDAMMSNSGGLAGNEHLGGKMEVPGAYGLYHSAEDFGMSG

SEQ ID NO: 2075 - protein, 716 aa, Eucalyptus sp.
MHSRKNLAQKEDFLKAESGSEVLASLILRNRRRKKHKQKLQSSVKARGSTLAKKRANNSIRKRLVRRNSSDKDKLINLKAFHNKKIEIVPEKLSSPPSSERELPIASDENVQNTDEDVKVNKLRRKRKKKMRKHFSKLDEASRLQRRTRYLLIKMKLEQNLIDAYSGEGWKGQSREKIKPTKELQRARKQILNCKLGIRDAIRQLDSISSVGSIEDSVIAPDGSVHHEHIFCAKCKTNETSSDNDIILCDGTCNCAFHQKCLDPPLETESIPPGDQGWFCRLCECKMEIIESTNAHLGTHFSLDSNWQDIFEEEAALPDGGIQVLDLDEKWPSDDSEDDDYDPEKMTNTGINCAGNDDSQSYDTSSSTSLSWSLDGEILSGPTISGKEGLNYPESIAGSDVLMDTDTDTVCGPRQRNAVDYKQLYNEMFGKDTPACEQASEDEDWGPNKRRRRERETDAASTLMTLCESEKNNPFIDQASEGDKKLSAEARMRRRIFRIPPTAVEKLRQVFAENELPSRSVKENLAKEFGLEPEKVSKWFKNARYMALKTRKAGGADQPPKSPQKHKESELAKMMKGAAPILSKDASTDIEFHSSLNTEKVIQQKSTKPIHGKGSPMVPEHSYMENFEFDDNMSLKQIKLLKGKPKDRKRVDFAASEGLREREAQLRELCKIRSRLDSLRKRTLTFQSSESKASDEFNTCRSRVVYVPVAEIKERA

SEQ ID NO: 2076 - skipped

SEQ ID NO: 2077 - protein, 815 aa, Eucalyptus sp.
MGIATPPLPPISSHTKTHHHHSIAISNPTKSMSQDYHHPSIFAFSNNGFERPDVAAASAASDQEQQHHVAQQICRDKLRVQGFDQPPPPQLVGMEEEPGGLPAYETAGMLSEMFNFPPGGAAAAELLEQPMASGYRAARPSLPTSEWYGSKNPGVYRRGESNMSQQHHHAHHHHQQQQQNQISNINAESAAAMQLFLMNPQARSLSPPTPHHHHHHPPPTSSSTLQMLLPNPSPPPSLQGFHVSGSGSAAPNYGTGMIPPAQFTWVPDGGAATAAQLNNPSEISGAAVVEGQGLSLSLSSSLQHLEAAKAEELRMGDSGLLFFNQAAGGGSANSSASASAVAASVQYHHQFKNLGVHNLQSHHHQVHVGYGSSPSSSSLGVVNVLRNSRYLKAAQELLEEFCSVGRGHFKKGKFGRNTSSSNPSSNPSNNNTSSASAVGGGASSSSSKDVPPLSAADRMEHQRRKVKLLSMLDEVERRYNHYCEQMQMVVNMFDLVMGYGAAVPYTALAQKAMSRHFRCLKDAIAAQLKHSCELLGEKDGAGSSGITKGETPRLKLLDQSLRQQRAFHQMGMMEQEAWRPQRGLPERSVNILRAWLFEHFLHPYPSDADKHLLARQTGLSRNQVSNWFINARVRLWKPMVEEMYQQESKEGDEDDDHQAERSESSRNNLSTSGHAQTPTPSSFTPPPINNNTNSNNASTPTRRSEINAPESDPSLTPAINRHPFSETQATTLLQATTAMISSAVQVAGPAHIDDPCRRSIGGSTGLGGATDIGSALIRFGTAAAATGDVSLTLGLRHAGNVPEKSSFSVTDLGGC

SEQ ID NO: 2078 - protein, 252 aa, Eucalyptus sp.
MCPIDSGRSFDTSLSLGLGCYGDPEDHEIKIKKPLAKLSGNSTCLTIGLPGGEACGLGSASGDEVRNIPSRSASSFSNSSSAKREKAEQGEEEAVERGTGSPRATINIEDEDEFSPRKKLRLSKAQSSILEESFKAHTTLNTKQKHDLANRLNLRPRQVEVWFQNRRARTKLKQTEVECEMLKKCCETLKEENRRLKKELQELKSLKPTASVYRQIPAAALPLCPSCERIAHPEFPFSTESRLWPAHPSAAC

SEQ ID NO: 2079 - protein, 438 aa, Eucalyptus sp.
MDGSQGKSNAPAPFLVKTYEMVDDPQTDFLVSWSESGSSFVVWSPPEFSGELLPKYFKHNNFSSFVRQLNTYGFRKIDPDQWEFANEEFIRGEKHLLNNIYRRKPIHSHSGQGARLSDTEKQMYEEEIKRLRHEKSSLQLELQRYQGDNQDVDFQIQLLRKQFQNMEQKQTHLITVLAQLMQKPVFASLFTQQSDSPTKKRRLAELDHLHDSDDKSGLESLKFQKEKFNGVPFSLLDLDSVEKLEQSLHFLENLLQGVDNTSGAEQHDFGAISLPWPAGFTERKESLDDSDRHIRPWSPGSPPSPKDVALSPELALGTDHLESPETSSVCLNMDISLKSSVIDVNMEPVCVPDVENLKEQILEKMPGAPTAVNDVFWEQFLTEAPCASDSQEVESERREGSGSRSPMKLANRGKFWWNSHLGNDFTKHVGSLASEGRS

SEQ ID NO: 2080 - protein, 260 aa, Eucalyptus sp.
MNPEEERYPKSPPGSPDRGRGKGKAPAGAGSSFSAALQPETPSFVMGSEALPSGSFFDMESIGLSGSPLPLMEFEAFSPLNTSSSFDLFFEVKPEPVLETTRPLGPPFGAGAVETEEAGFPARGGDMETTVGAPQPLERLQGTPVPPFLSKTFDLVDDRSLDPIISWGSSGESFVVWDPVEFARSVLPRNFKHGNFSSFVRQLNTYVGICWNTAFIGCCSLSVNAFFSLCLFLLLYFDVFLFHFLLHRCAFSFVSCLTLL

SEQ ID NO: 2081 - protein, 330 aa, Eucalyptus sp.
MAPPPPPPLEQRGDSPAGESQRSTPTPFLTKTYQLVDDPAVDDVISWNDDGSAFVVWNPTVFARDLLPKYFKHNNFSSFVRQLNTYGFRKLVPDRWEFSNDCFRRGEKRLLCEIQRRKVSPSPTAAAVAVVPDSVATLPTAIPTAMPVISPSSSGDEQVMSSQHSSPPSACGQNCTAEIMDENERLRKENAFLSRELTQMKSLCNNILSLMSGYAPNGRPQEASSRPVARALDLMPVKRPTGGGGGGGGGDGDDEEEEEEEDEEEDGEGSPKLFGVALGMKRGREIREGEVAVMSGSDAMLRLQQPGSGGVKFEPSDGDQRAISFPSGIA

SEQ ID NO: 2082 - protein, 438 aa, Eucalyptus sp.
MDGSQGKSNAPAPFLVKTYEMVDDPQTDFLVSWSESGSSFVVWSPPEFSGELLPKYFKHNNFSSFVRQLNTYGFRKIDPDQWEFANEEFIRGEKHLLNNIYRRKPIHSHSGQGARLSDSEKQMYEEEIKRLRHEKSSLQSELQRYQGDNQDVDFQIQLLRKQFQNMEQKQTHLITVLAQLMQKPVFASLFTQQSDSPTKKRRLAELDHLHDSDDKSGLESLKFQKEKFNGVPFSLLDLDSVEKLEQSLHFLENLLQGVDNTSGAEQHDFGAISLPWPAGFTERKESLDDSDRHIRPWSPGSPPSPKDVALSPELALGTDHLESPETSSVCLNMDISLKSSVIDVNMEPVCVPDVENLKEQILEKMPGAPTAVNDVFWEQFLTEAPCASDSQEVESERREGSGSRSPMKLANRGKFWWNSHLGNDFTKHVGSLASEGRS

SEQ ID NO: 2083 - protein, 286 aa, Eucalyptus sp.
MAAPPAEQSGSASGGESQRSVPTPFLTKTYQLVDDPAIDAVISWNGDGSSFIVWNPTVFARDLLPKYFKHNNFSSFVRQLNTYGFRKVVPDRWEFSNDCFRRGEKRLLREIHRRKISASPPAPAIVAAGRPRASPSNSGDEQGISSWSSPPSACGRNCASEIMDENERLRRENVLLSRELSRMKTLCSSIFSLMSNYANGGVRAEAAGEKKPLEPLGGNPEAEAAAAAAAESPRLFGVPIGAKRGREEEVRTEIKLEPLDCQRNGGRSRAEPWMKQCHRSNQRVFN

SEQ ID NO: 2084 - protein, 788 aa, Eucalyptus sp.
MNLCWFAWDLKLRSNFNGNWQMGTKRPKPEDLSVPPGFASLTSFLLKRAQEADAEPAVAHASTNRRPWVLHHESGTRHGARDSDSAKHEAEAVVVQAGGDSENAITCIFEEAPVFRPTKEEFGDPLAYLTSLHQRAEAYGICRVVPPPSWKPLCQSTEKNIWGSARFRTQVQRLDLLLNTHLPRETVKCNGNADCKDQNIFTRHPCEDGRLCTEGIQWECGPEYTLETFKKYADDFQENYFLKKDYDMKSDDDVQNIECEYRQICENPTNKIEVLCSDALDSRTFGSGFSSTFNSGWNLNDLPRLSGSLLSFESFSTCSILAPKLHVGMCFATSLWKCEEHCLYSVCYTHIGAPTIWYCIPGRYRAKFEAIVKKYSMELLSVQHGLNVFSHISPSTLKSQGIPVYRCAQNPGELVVIFPGAYKSGFSCGFNCVESVNVAPLDWLSHGQNIVELYREKRRKTMISHDKLLLGGAREAARAQWELLLLKKETADNLRWKHACGKDGILVKALKSRVKWESLRRKYLCNSSQSKKMDQNFDASSKRECGICHFDLHLSAVSCKCSRDKYSCLDHATQICSCAWTNKVFLFRYEVGELNLLIEALEGKLSAVYKWAKALGLAFKTSTEDLLVSSVLVSKSTSDAEPTDSGQKVSTSASITSRAHIKAELKEDLIKKMSSDGLRGEVNNDFGKAESSSHSHRHIIGVLSESASVSVSSDSEDEITNFVSHSGVKAAESNNDMASTKQSIVDSPTSTVKKAPSFGKLAPGKLMAKDARSCSPLNVIVLSDDDND

SEQ ID NO: 2085 - protein, 964 aa, Eucalyptus sp.
MDHSRLASGNAEDNVGIPDDMRCKRSDGKQWRCNAMCMPDKTVCEKHYYQAKKRAANSALRASMKKAKRKSIAESDIYLESKNDDFDMPLINMKTADHPLPTSGKKSKNKVSKNRVQHSPETTPPQSSSRNFRRSVDNSQRELTEFEENWRPYKTPTGNSSRNRSQRSYDTSPMTEYSERSTDSSEDTGGHICHHCRRNSRDKVIWCLKCDRRGYCDSCISQWYSDISLEDLQKACPACRGACSCKVCLRGEHLIKMRIREIPVLDKLQYLYCLLSAVLPVIRQIHYEQCSEIELEKRLRGPDIDLPRVKLSADEQMCCNICRIPIVDYHRHCTNCPFDMCLHCCQDLREASRDRARETSANDQIGGSTQDKESVDYVKGPKVRLKFTDNFPDWRAGSDDSIPCPPKKYGGCGYPSLNLTRIFKMNWVAKLVKNVEELVSGCKVNNSANQQNDGSSQSNFGQEASIPIKEGKKGSLYCPTSHDIRAQGISEFRKHWFKGEPVLVKQVWDHSCISSWDPVLIRRGIQDMADEKMKYENKKVRAVDCLKSSEIDIDLDQFIKGYSEGHIHENGLPKMLRLKDWPSPGASEEFLLYQRTEFISKLPLLEYIHSKWGILNLAAKVPHYSLQNDVGPKIYISYGTKEELGKGDSVTNLHFNMRDLVYLLAHTCEMKCKSWDKTKLGKNRRSTGQSILKQMHGNLDSGGDGRHLPDQHAGRYNILEDHGAHLVTNADERIEDQEMGMPSLVEEKNANLELLNRDDEGGCGNNTSGVHWDIFQRQDVPKLINYMQKHWKELGMPGSLDDIATYPLFDDVIFLDTQHMRKLREEFGKGISVLLHFMLFVEPWSFVQHLGQAVFVPAGCPFQLRNLQSNVQLGLDFVSPESLGEAVRLAEEIRCLPNDHESKLQILEVGKISLYAASSAIKEVQKLVLDPKFGAELGFEDPNLTSEVSANLEKITKRKQVACS

SEQ ID NO: 2086 - protein, 612 aa, Eucalyptus sp.
MVAAVFPKHRQLSHYAGNANLNIPRSSKAEKLATSRRFPRSSLDGMDSRTLEDKGKPIMVTHAKRTEVVSQDKGMKKRKLDGIDECLNGKNIAKKYRSATGKRSSVNGSSRTRWESFDQVKSSFKMQKLSKSEKPQAGSRTRKFRTYKPQRDSSEGLSDVESMDNGSSEDSEEARIVKMRTRRRRENKFDLMNDSLHDSSSASPSSSGSFHSTLKIDYTGDTGCSKGKYEAQGKQRLRCHQCMKKERRIVVPCTSCKQKLYCIQCIKQWYPQMSEIDIAELCPFCRGNCNCSCCLHSRGIIKASKMSMSDDEKVQHLKYIIKALHPFLRQICKEQIQETRIEANIQGMPFDEIEVPMSLCHNWERVYCDNCATSIVDFHRSCPECSFELCLNCCQDIRRGKVPSRAEVKLQFEDRGNEYIHGGDPAPILVPNTEIFRSNVAQSIEWKANTDGSINCASKEMGGCGNHKLELKRILDKDWIRRLELRARNLLKIGKPEQTIQKHNCSEIGDEMLRKAASREGSTDNYLYCPASSAFLDEEELLCFRRHWIKGEPVIVQNVLERTPGLSWEPMVMWRALCENMDSASGSKFSEVRAIDCLAGCEVNIIIPPLVF

SEQ ID NO: 2087 - protein, 953 aa, Eucalyptus sp.
MDHSRLASGNAEDNVGIPDDMRCKRSDGKQWRCNAMCMPDKTVCEKHYYQAKKRAANSALRASMKKAKRKSVAESDIYLESKNDDFDMPLINMKTADHPLPISGKKSKNKVSKNRVQHSPETTPPRSSSRNFGRSVDNSQRELTEFEENWRPYKTPTGNSSRNRSQRSYDTSPMTEYSERSTDSSEDTGGHICHHCRRNSRDKVIWCLKCDRRGYCDSCISQWYSDISLEDLQKACPACRGACSCKVCLRGEHLIKVMRIREIPVLDKLQYLYCLLSAVLPVIRQIHYEQCSEFELFFSTGPDTDPPRVKLSADEQMCWFNICRIPIVDYHRHCTNCPFDMCLHCCQDLREASRDRVRETSADDQIGGSTQDKESVDYVKGPKVRLKFTDNFPDWRAGSDDSIPCPPKKYGGCGYPSLNLTRIFKMNWVAKLVKNVEELVGGCKVNDSANQQNDGSSQSNFGQEASIPMKEGKKGSLYCPTSHDIRAQGISEFRKHWFKGEPVLVKQVWDHSCISSWDPVLIRRGIQDMADEKMKYENKKVRAVDCLKSSEIDIDLDQFIKGYSEGHIHENGLPKMLKLKDWPSPGASEEFLLYQRTEFISKLPLLEYIHSKWGILNLAAKVPHYSLQNDVGPKIYISYGTKEELGKGDSVTNLHFNMRDLVYLLAHTCEMKCKSWDKTKLGKNRRSTGQSILKQMHGNLDSGGDGRHLPDQHAGRYNILEDHGAHLVTNADERIEDQEMGMPSLVEEKNANLELLNRDDEGGCGDNTSGVHWDIFQRQDVPKLINYMQKHWKELGMPGSLDDIATYPLFDDVIFLDTQHMRKLREEFGVEPWSFVQHLGQAVFVPAGCPFQLRNLQSNVQLGLDFVSPESLGEAVRLAEEIRCLPNDHESKLQILEVGKISLYAASSAIKEVQKLVLDPKLGAELGFEDPNLTSEVSANLEKITKRKQVACS

SEQ ID NO: 2088 - protein, 162 aa, Eucalyptus sp.
MAKEKIKIKKIDNLTARQVTFSKRRRGLIKKAEELSVLCDADVSLIVFSATGKLYDFSSSRQMKGEDLEGLNVEELDQLEKKLEAGLSLVIKNKEEKTWNEINKLQRKEAQLIKQNKQLKHEMKMILHQEKSVTVNSESVKDVYISRNSMPPLDGDSPNPSS

SEQ ID NO: 2089 - protein, 228 aa, Eucalyptus sp.; identical to SEQ ID NO: 1111

SEQ ID NO: 2090 - protein, 208 aa, Eucalyptus sp.
MGRGKIEIKRIENSNNRQVTYSKRRNGLIKKAKEISVLCDAQVSVIIFGSSGKMHEYCSSNTSLVDILDQYHTQCGKRLWDAKQENLSNELDRIKKENDNLQIQLRHLKGEDITSLNHRELIILEDTLENGLGCVRDQKDEVLMTHRRNQKQLEEDAKELHFYAQQKDMMMAETGRAGNDGYHQRMKADFGPSTYHVQPIQPNLQRRF

SEQ ID NO: 2091 - protein, 248 aa, Eucalyptus sp.
MGRGRVELKRIENKINRQVTFAKRRNGLLKKAYELSVLCDAEVALIIFSHRGKLYEFCSSSSMLKTLERYQKCNYGAPEPSISTREAQLELSSQQEYLKLKARYEALQRTQRNLLGEELGPLSSKELESLERQLDSSLKQIRSTRTQYMLDQLTDLQRKEQHLNEANRTLKQRLMEGYQATALQMNPAAAEEMVYGGRHLAPPHHGHDAFFHPLDCEPTLQIGYPQDPSASVVTAGPSSSSYMPGWLP

SEQ ID NO: 2092 - protein, 222 aa, Eucalyptus sp.
MGRGKIEIKRIENTTNRQVTFCKRRNGLLKKAYELSVLCDAEVALIVFSSRGRLYEYSNNSIRSTIERYKKANSDSSNTSTVTEINAQYYQQESAKLRQQIQMLQNSNRHLMGDSLSSLSVKELKQLENRLERGITRIRSKKHEMLLTEIEYLQKKEIELENESVFLRTKIAEVDRIQQGNMVAGPQVNVMEALASRNFFPSNMVEGGTVYSHSDKKVLHLG

SEQ ID NO: 2093-2094 - skipped (2 entries)

SEQ ID NO: 2095 - protein, 227 aa, Eucalyptus sp.
MAREKIQIKKITNATARQVTFSKRRRGLFKKAEELSVLCDADVALIVFSSSGKLFEYCSSSMKEILERHHSHSENLGKLDQPSLKLQLVENGDYSRLSKEVAEKGHQLRQMRGEELQGLNIDELQQLEKSLEAGLNRVIEKKGEKIMKEITDLQQKGAKLMEENKRLKQQVTEILGRKTTATDSETIINEEGLSSESVTNVCSSSSGPPQEDDSSDISLKLGLPYNG

SEQ ID NO: 2096-2097 - skipped (2 entries)

SEQ ID NO: 2098 - protein, 201 aa, Eucalyptus sp.
MGREKINIKKIDNLMARRVTFSKRRRGLIKKARELSVLCDADVSLIIFSATGKLHEFSSSSMEDTVTRYVLHSNIVEKPVQPCLPLQKDSSNLEMLRKEVNDKAYKLRQMRGEDLERLDVEGLRQLEKKLEAGLSLVIKTEEERASTKINELQGKEAQLIKENKQLKQKADEGRGSGGGGRGEIGTIREQSRGRTEPRAQD

SEQ ID NO: 2099 - protein, 244 aa, Eucalyptus sp.
MGRGRVQLKRIENKISRQVTFSKRRTGLLKKAHEISVLCDADVALIVFSTKGKLFEFSTDSCMESILERYERYTYAERQQVATDSPQVQGSWSLEYPKLVARIEVLQRNIRNLSGEELDPLSLRELQYLEQQLDTALKRIRTRKVVDFSAAKKEKSLQEQNNVLSKKIKENEKVMRESGQWEQQTPAPTTSSFMLQPTLPLPSLTIGNTFQTPHVLGGAEQEERSQARPANTLMPPWMIRRSNE

SEQ ID NO: 2100 - protein, 232 aa, Eucalyptus sp.; identical to SEQ ID NO: 1132

SEQ ID NO: 2101 - protein, 759 aa, Eucalyptus sp.
MDTYSSGEDLLIKGLRSSLALLLSNYPHICSQSLYSDRPFCSQTRKPYTITKQRERWTEDEHNRFLEALKLHGRAWQRIEEHIGTKTAVQIRSHAQKFFSKLEKEAIVKGVPVGQTLDIKIPPPRPKRKPSNPYPRKTGAITPTLSVGAKDGGILSVSPSNCEKLDSETAPFLERASGGEKLANSKENQDDNCSEVFNLPQEAHCSSISSTNRSVVPTPVGIQNSCTFRKFVPSLKEDNGPRKVSNSENSDRSHEKSVQCRMDGYDGPPADEMQTAHNFPRHVPVHVLDANHTKCTQAPLQDVSFQDSAFDPTGEVKARLNLFPNQTPSAAGENQKEAPRMDHQSFPAFHPPFTPVHHNEDDYRSFLHLSSTFSSLIVSTLLQNPAAHVAASFAASLWPYPNVENSVVDSAVCTQGTFPCRPSSSPPSMAALAAATVAAATAWWAAHGLLPLCAPLHTGFTCNPTSATAVHSLNTSQTPGVEKERRECTFENPCSQEHLDPEHSEALQAQNSASKSPLGALSDSEDSGGARLDTRSKAADHEKAAVETDSQQNQSKGGKPVDRSSCGSNTPSSSEVETDALEKQEKGNETLKDPDPNQSILEYFNRRCRSTSNVTDSWKEVSEGGRLAFQALFSRNVLPQSFSPPRDMKNKGQQKENVEEGEQNNGEVDKDVSTLDLNRNMCISCSFHQGSERSGVIDDGEEGLLTIGLGQGKLRTHRTGFKPYKRCSVEAKETRAANVGSQSEEQGPKRIRLEGEPSM

SEQ ID NO: 2102 - protein, 357 aa, Eucalyptus sp.
MGRSPCCEGNGLKKGPWSSEEDKKLLDFIQQHGHGSWISLPKRAGLNRCGKSCRLRWINYLRPDIKRGSFSPEEEQTILHLHSVLGNKWSAIATRLPGRTDNEIKNYWNTHLKKKLIRMGFDPVTHRRRTDVFSSSLSQLIALANLSKLIDSRPLDESALALQSDALQLANSLQYLQGLLQPPASATASNNNLFSQTSCITEATQGYTAYDPIKEDPDLNSLLSSTARLFSEGIAGFSQPLQDNNFIAHHHLVPNYLTNTPPQVPFSFQTSLNNHVDRTAATQCLSMVNGIDHCLDSTDSALWGDYDDLDLLLPPSLTEASAVTDRGDARSGGSSGGSPSSSTSPWSDIFFGDLAGH

SEQ ID NO: 2103 - protein, 190 aa, Eucalyptus sp.
MTPQEERLVLELHSKWGNRWSRIARKLPGRTDNEIKNYWRTHMRKEAQEKKHALSSSSASSNISSSSSNNPTVDSLTTQETGKESFYGTGGPGDMLTSTEQNIEEQGKSESACSFDDIWKEIALADGYGILPVYDGYSEESCNFSCPPMASPTMEYNSDPLWLTDEEESKMFPINQFIPDYEHGGAYITG

SEQ ID NO: 2104 - protein, 246 aa, Eucalyptus sp.
MVRAPCCDKANVKRGPWSPEEDATLVNYINKHGTGGNWIALPRKAGLKRCGKSCRLRWLNYLRPDIKHGGFTEEEDHVICTLFFTIGSRWSVIASKLPGRTDNDVKNYWNTKLKKKLMKQLASLKTVPESNFDYQVCAQNSASIDPETKNREYAANSMGFPKQNFNPGIPTSNSSLLCPPSLTEVSDFSHVPSSTPEVSSHSDSCSVVMKSEYSGSANGSSEQDQVLLDFDFDSMLNDFGFQDQSS

SEQ ID NO: 2105 - protein, 406 aa, Eucalyptus sp.
MGRHSCCYKQKLRKGLWSPEEDEKLARHIVKYGHGCWSSVPKLAGLQRCGKSCRLRWINYLRPDLKRGTFSQQEEDLIIDLHAVLGNRWSQIASQLPGRTDNEIKNLWNSSIKKKLIQKGIDPNTHKPLSEVKNGREGEKTPKSGNFGNRTSGGFSSMYNLEFDAPKSEERKPISQDAEPYSLTGSLSLKIHHPDTSKSINPAPARKLFSEKSADLSEKIPFEPTRIFPFQQLSYGSSADYSFDPYLNHNFMLSDSKSALHSTSAPAILPQSHSFSSLTAQPHDSLKPHFGLFSNGKIRSSESQSSLFPWDLHAEKEEDETHQPNFSGNESEDLKWSDYLNMPFLIANPGQGQEKQAPPNGVVSDARFISELSCVEGNNQQQELPSQGSDIYCKGIRRLAAAFGNY

SEQ ID NO: 2106 - protein, 388 aa, Eucalyptus sp.
MGRAPCCEKVGLKRGRWTAEEDEILTNYIQAHGEGSWRSLPKNAGLLRCGKSCRLRWINYLRSDLKRGNITAEEEKLIVQLHGTLGGLWSLIAGHLPGRTDNEIKNYWNSHLSRKIYVARPSTSTRVEPSLPTPMNAVKIAGTGKRRGRTSRSSMRKSSFTSMPPERPNHSTVPKSEKGKEAQAPIKGQVGGSQVMSSEPSWVPNKKTAAQESNKDVVHGSRIDTDAGLNNEVAAEAEGLFLGPCEWVDREIMRLNCMLHIEDAGALKLEGENGVVGRFEESENEFAVMEKLMPVTEETESSIWSSKSNAESSTGEWYVSSSSMNYNKYNNDSGFDEWFDWDWAGGVGCGSNQWENEDKTLSWLCDSGNGEAENASDSTAVMKSETIM

SEQ ID NO: 2107 - protein, 483 aa, Eucalyptus sp.
MAGEAQNEVAVSSALFTVPNRPSKVGSQLEAVDNLKELQVLENDQTPKVRKPYTISKQREKWTDEEHERFLEALKLYGRGWRQIEEHVGTKTAVQIRSHAQKFFSKVARGVSGSSEGVIKPIEIPPPRPKRKPMHPYPRKSVDSKEVKLSYQQERSPSPISSVADENTGSPTSVLSAHGSDMLGSASLHQQNRCSSPTSCTTDVPSIGLAVIEKQPEIFKEEDKGCLSSTQMPSGLTLGNLPSMNCDLSSRNTSSPEEIGGTEAPSIKLFGRTVLVTEIQKPDHQEAGIKKSPVQKTGEDDSVTEDEGLGKPLSSVEFDMQLSLGLACGNNGFLHSGAHAATAMKLQKEDVESSRFTSDCFLPWWPLYQGPPFIYVTPSDSTLIQGPLDSHKDRKMEVEEIIKETSSETNTVAKKTEGYGDNNVENNVDGVFPKCQKHLERRTHPGDCKKGFVPYKRCLAERDVKSPVIVSEERQAQRTRVCS

SEQ ID NO: 2108 - protein, 489 aa, Eucalyptus sp.; identical to SEQ ID NO: 1191

SEQ ID NO: 2109 - skipped

SEQ ID NO: 2110 - protein, 297 aa, Eucalyptus sp.
MSRSCSQCGNNGHNSRTCMDGGGAGGGGGGGCGGEGTGGIMLFGVRLTADGSAFRKSASMNNLSQYEHSPESSNVVDAGYASDDVVHPSGRSRERKRGVPWTEEEHRLFLLGLQKVGKGDWRGISRNFVKTRTPTQVASHAQKYFLRRTNQNRRRRRSSLFDITTDSYFGVSSSTMEEGHHQAHQVPSFPLSLPPAVSPGTGEKLLESLRLRKEGCQSKPTPSKPIRPVPILPIPPSSKMAALDLNKATAASEPAEPWPLSLKLATAKPSDDQQAAAAPAPATTPHSSPTNSIISVA

SEQ ID NO: 2111 - protein, 195 aa, Eucalyptus sp.
MDKKPDDDNGKSQDVEVRKGPWTMEEDLILINYIANHGEGSWNSLAKAAGLKRTGKSCRLRWLNYLRPDVRRGNITTEEQLLIMELHAKWGNRWSKIAKHLPGRTDNEIKNFWRTRIQKHIKQAEAFSGQSSEMSDQASTSHMSSMPEPMETYDSPPSFQGNNNMEPLPVNLSVESNEAYWSMDDLWSMQLLNGD

SEQ ID NO: 2112 - protein, 382 aa, Eucalyptus sp.
MGRHSCCVKQKLRKGLWSPEEDEKLFNYITRFGVGCWSSVPKLAGLQRCGKSCRLRWINYLRPDLKRGMFSQEEEDLIVSLHKVLGNRWAQIAAQLPGRTDNEIKNFWNSCLKKKLMKQGIDPATHQPISEVQLIKEEKCAKNESLQVPQLKGLTPAVSSSRAHEPAFLISDTCYEGGALIEPSRESVDNNNYMSRPVFDSLPYFEFQSGVDMVGFNSNLLSQYHDPPRTIDQSHLDISSNFEFSSMPSLTNFDHPGATMSGSEFSNNSTSRMSPFFFHEAKDQCSTNNSSSIGNYTGFQVNSSVENAAFSWCSSENKLDCLFQYQANGTSKSEELKPQGSWQEDQLHIGPVNSSSEDFGSFQLTSLSDDLTAANFDIFQQM

SEQ ID NO: 2113 - protein, 296 aa, Eucalyptus sp.
MGRKCSHCGFMGHNSRTCASIRRRDASFGGGGRVKLFGVQLEAAYPCGVASRPPLKKSLSMDCLMPSVRVLTSSSPLSSATNSSLSLRAACDVGDRLLRDESPNKAANSPSNDGYASDGFLGRAQERKKGLPWTEEEHRTFLVGLETLGKGDWRGISKKFVGTRTPTQVASHAQKYFLRQKSLLPRRSKRRPSLFDVGMERCSARHHGQIPKPSESFTPICLFSPQFGSTGRDSRARMVLLASPRTCSFRDREIPSSNLANHASSVSGRPASNPNLELTLASPNHQLDQASSIRVT

SEQ ID NO: 2114 - protein, 438 aa, Eucalyptus sp.
MTVQDQDGSAHSSNMIVGSNEMSLSDSLHSITSISLKEQFSCANDYAPKVRKPYTITKQRERWTEEEHKKFLEALKLYGRAWRRIEEHVGTKTAVQIRSHAQKFFSKVVKDPTDGKVETIEIPPPRPKRKPMHPYPRKLLAHPINKESLPQEQPIRSGSPNFSVSELENQSPMSVLSTLGSDGLGSSGASTPSGSSSPSSSGGAACRAGLSLFESPAEENGPITSEKLELHARGCEASGGAMEEAPSRTLKLFGMTVSVTDSHWQSSSAIKSESKEMKLQDPLSQDTLSATSPAKTNRVLNLVQPRDTSTDRMEAGPAPSAPWLNLYGNLTISLSPIRNKVAPRSTCGDINKNGIPESRNGVTSNEFHSGFDLKLSFLSKPSSTSVAPELMTRQERRGRGFMPYKRCMAEKETQPSGATGLEREVQRVRLSLECASSL

SEQ ID NO: 2115 - protein, 347 aa, Eucalyptus sp.
MGRPPCCDKTGVKKGPWTPEEDIVLVSYIQEHGPGNWRSVPTNTGLLRCSKSCRLRWTNYLRPGIKRGSFTDQEEKMIVHLQALLGNRWAAIASYLPQRTDNDIKNYWNTHLKKKLKKLQGQANPDDDDHNHHPQGFNATSHSNPKGQWERKLQTDIHTAKQALYEALSLDNQHSFLNETTTALGDGGGVCDRPPHQESSYASSTKNIARLLEGWMKSSPISGKIKVETAARSANVSNKMAAAAGSRSTSEGGVAGVATPECLDSLFSFNSSNSDVSQSVSADENNVNLTPETSTIFQEESKPGLESNDNHQVPIKLLEKWLLDDAAAQALQDDYLMDMALDQDALF

SEQ ID NO: 2116 - protein, 159 aa, Eucalyptus sp.
MRDVKEKEEKDDGKMLKLPPGFRFSPTDEELVLHFLHPKKQQASLSPLYAHLVPDLKSHHHDPWDLHGKALSNGSHYFYFSRMMNNRITENGYWKDLDMEEPVFGEAGEIIGMKKSLTFHIGEAPTGQETNWVMQEYHLVSFHELANSTQVSANIPQKC

SEQ ID NO: 2117 - protein, 286 aa, Eucalyptus sp.; identical to SEQ ID NO: 1202

SEQ ID NO: 2118 - protein, 294 aa, Eucalyptus sp.
MKRAQLELPAGFRFHPTDDELVNDYLIRKCASHAISVPFIAEIDLYKFDPWVLPEMALYGEKEWYFFSPRDRKYPNGSRPNRAAGTGYWKATGADKPIGRPKTLGIKKALVFYAGKAPRGVKTNWIMHEYRLANIDRSAGKKKNSLQLDDWVLCRIHNKKGTIEKHSPSTLNETADFPEMEIKPQIVTPAALNPYTSPQYADSPMTTDHMYTDSSEFLPKLHTDSSCSEHAVSRDLAWEKEVQSEAKWDDWEKALDFQFDSVDNFLDDAFANEQYQLDQFSPLQDMSMYLQKSF

SEQ ID NO: 2119 - protein, 302 aa, Eucalyptus sp.
MSNISMVGAKLPPGFRFHPKDDELVCDYLMKKMTRSDSLLMIEVDLNKCEPWEIPETACVGGKEWYFYSQRDRKYATGLRTNRATASGYWKATGKDRAVLRKGTLVGMRKTLVFYQGRAPKGRKTDWVMHEFRVEGPHGPPNITKISSLKEDWVLCRVFFKSVEVATKPSTGIVSCYDNRGTSSLPSLMDSFITFDQAHPQPNLISNIEQVPCFSIFSPSQANPIHVEPSMPARTILNASAFGAMPDFSSCNNLDSYACDRKVLKAVLNQLTEMDSPSLGDQGSSESFLSEVAMPNNMWNHF

SEQ ID NO: 2120 - protein, 538 aa, Eucalyptus sp.
MPCLIPVDVFYEHIDCFLPVGYRFRPTDEELINHFLRRHILGYRDDPCIIPETPFVHKFDPWHLPRLFRERSIVRSKEAEWWFLSRLLFKTQKNSKYDRQTPSGHWKTTGQEKKINAKSTNRLIGTMRNLVFIENEGSSAKETVWVMHEYCLHDNYGANFLDQQKFVLCRLINKRDEFIDDSTSVEAGSISLLMNLGNDKAWSNIPENIIEATMDQLAEALCPPMNLNLSSNPHLVDMGAPSHVHIANDNLDQSDQQGDVVDGIETDGSIDDILDAIDWNMDEICQQRSGTEPETDNGQGWGLPADRPIEQGEHADRLRQPTIRLVDDRPREETSIHAQDNSQEQNIAHIFMIQPIEEYPEINCLTRAPVPTRASRGRDRVQLHNGHGLASKAKVTGLVENYGEINCLTREPVTIQASRGRDRVHLQNKPSVRLVSKVKDKESKGEKDKAAANISKNVFSMRELKACLEQTQEIEQSSKSKSSVFPASSAKSPIMAPDKCSQGSVSSANSNRTKHFKSKSFQTEAKPNRKVKPSSKTR

SEQ ID NO: 2121 - protein, 446 aa, Eucalyptus sp.
METRIYPMNILPAENELTKIVLFLQQAIEGFRFCPTEEELLNHLKLTVSGCRESFCIIPTLENIYEINPWDLPAKFSEKSIIPSKDQEWWFICPQTQSQRISRKTPCGSSWNITGKHKDIKAKNDNKKIGSRIILVFHDGQNSKGTRSKWVMHELHPHPDNMGYVLCCLKMKQHGKADNQEPSNQVRENQPNDAAMAMDGDIPSIPQFHCPEVSSSEQNKVIAELSKKNYSKSDRSCQNKTKSLALIHEDNNPFSQSDGSYQNNTNSPALIHKDSHPFSQSDGSYQNNTNSLALIHQDNHPFSQSEGSYQNNTNSLALIHEDKHPFSPNQKHLAWTKNSSSTANSSGSCLAVSEPSIHELHFPHPFPNFDDTSGTSNFNGEQADKSCYSMDCENPEQLPFAEVRKIRMLQRSNFFFLFQSLEICNYIWDVHVFLNNSIRSRKCRTN

SEQ ID NO: 2122 - protein, 218 aa, Eucalyptus sp.
MAKLNQIRAIGSMSKLPPGFVFEPTDEEILFEYLRRKIFALPLPASIIPELINLSNLDPWDLLGNGEQGRYFFSNLAGANNAVIRATSCGYWKAQGVPKQISPSSSDAHNRMIVGMKKTLVYHRGRPPHGSRTSWVMHEYRLVPSPSAARGPQLNSWVSELGRWVMCRVFVKTTSSSSSHSDSTSMDVLSSSSSSSGSCLTEDSSSGDEEQTSEWFCS

SEQ ID NO: 2123 - protein, 271 aa, Eucalyptus sp.
MAESTEAWPVGLRFKPTENELISHHLTKKLKGEMETICVIPELYIYNWEPPELFARYKELSSIPSDGSECFFFCPRGRKRKRKTECGFWKETYSKRVIQAPDTGEEIGLRRGLVYHKGRQRNSQRTNLGMTEYHLNSNVSDSEISDPAAMVLCHIINRKSKKAKSPTAGTSTDLSGPRNLNDSQNEETQDTSERASPGVTVEFPLNETSNLNFPGQNVPIPDQQPQTTKEQCLSHDIYEHDEPSDGYCSLPYSSSDYIDLGDLFNFDESIN

SEQ ID NO: 2124 - protein, 270 aa, Eucalyptus sp.
MISNKKLRFDVIGFLNIYHYDPRELPGLAKIGEREWYFFVPRDRKHGSGGRPNRTTKHGFWKATGSDRKIVSLSDHKRVLGLRKTLVFYEGRAPRGTKTDWVMNEYRLPDDSSPKEMVLCKIYRKATSLKVLEQRAAMGEGMNKAATAAVAHLSPPSPFSPMETSSSFNTQQYDLMPSMRESKIVFKQELLEEAEDEQEVQGFITSPPQDLFVNKVMSKGSSSSLQMPTGKEKLPELQLPKMPADWTQDNFWTQFNSPWLQNLNTPYLTF

SEQ ID NO: 2125 - protein, 293 aa, Eucalyptus sp.
MAAWPVGLRFEPTEDELVDHHLRGKLKGKLEAFCLIPELYIYSCEPPDLFISYNELSAIPSDGRECFFFCPCGDKIPNNRRSNNRMTELGFWKDTCKKRVIRSLVTGKQIGIRKILVYYEGRQPKGRKTDVVMHEYHLNSSVSDSKISGQMAFVLCHIIDRKRKKARSAKACASASSSTISTPNDSGNGRSDEVSTEASEEVTIETQNQNEILISSMPDDNGPIIPQQDHMHEEQSPLYDGCPFIDGHSDELYDLLYSPSNGMEILDLWNVPTDELVCQSFLPGEEYDGLTFT

SEQ ID NO: 2126 - protein, 299 aa, Eucalyptus sp.
METRMSPMNLVPAEKIVTEMALLLQQAIVGYRFHPTEEELINYLKSKATGCRETLSIIPTLENIYESNPWDLPAKFNEKSIIRSRDQEWWFICPQTQNQRIGRKTPCGSSWKITGKHKDIKAENDGKKIGFKITLVFLDGRNSKGTRSNWVLHEFHLHADDMGFVLCFLKMKQDEKADNQEPSIQALRNQPNHAAMATNGDFSSTPQFQCPKVSFSELIKNGTKSVAQIPEDNHHSSPNLEHLTWTKNSSSMGNSSGRGLAVSPTNDELNFPCHFLNVDVCSAIEAQTEKMYRVNLFFQ

SEQ ID NO: 2127 - protein, 259 aa, Eucalyptus sp.
MEKVSFVKNGVLRLPPGFRFHPTDEELVVQYLKRKVFACPLPASFIPEVDVCKADPWDLPGDAEQERYFFSTREAKYPNGNRSNRATVSGYWKATGIDRRVVSSRSHQLVLGLKKTLVFYRGKAPHGSKTDWIMHEYRLVDGLAPGTALPPKMNLNQSPEVPRENWVLCRIFFKRRSTKNDGHNHNIESFRTTNEVSKVRGNGPVFYDFMARHKTDLNLTPCTSSSGSSGVTELSLRGGPEEHEESSSCNSFSLSRRIP

SEQ ID NO: 2128 - protein, 538 aa, Eucalyptus sp.
MGRDKGKSLAPGFRFHPTDEELIRYYLKRKVSGKPLRFDAISEVDVYKCEPWDLPDKSKLKSRDLEWYFFSVLDKKYGNGSKTNRATENGYWKTTGKDRAIYHYSRTVGMKKTLVYHNGRAPRGQRTNWVMHEYRLTDEELEKAGIPQDAFVLCRIFQKSGSGPKNGEQYGAPFIEEEWEDDDVALFPDQEQMVVVHDEYVEADDLDQSIEVGTEPGDAPVPLNFYHGETSQGTEHSNDLNEDEQKPLIDTNAIQASLQQQDEQFFVLPEQYRTEMKAIENGYIGQSDDNANPVDANYLLDEPYLDVAGDDYYLQTNDLANLLGEDAADFDVEDYLTFFDADDENLLPYESSQPPPENLLSDHALHAEHINGENEEAPLAGNLPSESCSKDCASTSKPHLDSKDPESSIKYPFMKAASQMLGSFPAPPAFAAEFPVKDAALRLNSAAQPSSSVHVTAGMIRIRNMNLVGSGMDWSIGKNGELNIVLSFGMSQADISPTDSGLRSRKTPSVASWTWCFLFFWIILLSVGVKVGTSIYSR

SEQ ID NO: 2129 - protein, 379 aa, Eucalyptus sp.
MEWNAKPPLQWEWENLMMFGSKATETSKPLRATDWGIEAEELIDPGSLFLYENGGGSSSCTSIDPGYTSVSKSSKSASVNSSSTDELKISKFSVEAHEGFSLQSSKKELAVNDFTGMSPALEPSVCSGEPLLSLKLGKRIYFENTIDKDHVKTQDLPSVMKSPDTPAKRNKSNCQGTSAPRCQVEGCNLDLSSAKDYHRKHRVCESHSKCPKVIVSGIERRFCQQCSRFHGLSEFDEKKRSCRKRLSDHNARRRKPPPDVTQLNPARLSALFYGGMQQLNPVLSRAPAIHTRSTASFKWADTQDTKLIEKGPKLPIGGGVGECITIPSNGIPDTLKSTGLGKSYNELLSSKGMPVKTTGGGMTCYIFCALQLHFVAFIS

SEQ ID NO: 2130 - protein, 318 aa, Eucalyptus sp.
MDSSSNGSLKRARAPGFGSQVASCLVDGCDSDLSKCRDYHRRHKVCELHSKTPKVIIRGQEQRFCQQCSRFHSLAEFDDVKRSCRKRLDGHNRRRRKPQPDPLSLTAGRFLPSHQGTRFSPFSGPQMFPASALASCSWPGVVKVEDDTTSYNTPQLINFNERNLSFPGSTSSHFKGHIQFPFLQGTSAAHLGASICKPALNPNSTTGTGGNGNNARSSSSGLNRVVASERALSLLSSPPAENSEKGLSRMMQLVPSTSAQSLTTDLRYNRLGLGKPGNPGMDSESTGSGELHYHGIFQSEHAGLSANGQHQTPSFSWE

SEQ ID NO: 2131 - protein, 551 aa, Eucalyptus sp.
MESWSYFSEGKALVSDEPVSPFDLLGRSKNAVANWELRSPPSFGNSVVVSGQEADVGQGFGQLGFQEIIRKQVHPKSPRHVLTDKFDDGNGANQILAALDSFGGEDESTSNLSVSGVDSNTQDSLLIDLKLGRFGESREVPGAKFPQGGKKVLSSSESSTPPKRARSVGSNCHTHYCQVFGCNKDLSSSKDYHKRHKVCEVHSKTAQVVVNGVEQRFCQQCSRFHLLAEFDDGKRSCRKRLSVHNERRRKPHVGVQSGSVGRMLQSYNGSGLERNLLAPTSFLCQDTLAGEKFLNSGPYGMNNWYEHIKAEDGIGLGPPSAIPTPNRHPNAISLISPYKFERQFALFDGGRVKSTASGISSKNNQVPRELGGQNSSHSSFQNTSFGSEDFAVFDTASTVQGISGIIESGRALSLLSSLSQNSSSHSRIPMAQSLVMAGTDYHFSLCGATDKLVDMSSHASVGVELKKLSSSVMDSAERNLPGHPLVSDLEITDGILGGSGFVNSKDNLSPEGGATTMNLLQLSSQLQRVEDQRQSIHLKEQNDVFGCHSIT

SEQ ID NO: 2132 - protein, 785 aa, Eucalyptus sp.
MEPPPSPSSPHLLPSMDLHAPPLLDGAAADAADCVWDFGDLLDFTADDALISPWDEPPALDNPASVPSDPDPDPAPEDPPAGGAAPPAATRVRKRDPRLVCSNFLAGRVPCACPELDAKMAEAEEEEAAAEGLHTKKRARAPRRAGTGQGIARCQVPSCKADIQELKGYHRRHRVCLRCANASAVLLEGDRKRYCQQCGKFHFLSDFDEGKRSCRRKLERHNNRRRRKPADSGSGLVKESQQDIHSEDVGCDDEDGKDTLCLSGQSVEKEASLEPEDGGASPLGSAPECQIISTDSIASAVSRETQMESRKDNSKFALSPSCGDNRSAYSSVCPTGRISFKLYDWNPAEFPRRLRHQIFHWLASMPVELEGYIRPGCVILTVFIAMPKFMWGKLYEDPISYINEFILRPGRLLSGRGTMYIFLNDMVFHLKEDETSVTKVEGGFRTPRLHYVHPMVFEAGKPMDLVACGSDLLQPVENQSGLSNFIPVLIGNKEVCSEMRMLQQRVDKSLLNEGPQISDIVMSQIHVGLSHRDKPHFLSSSWISHGCCGAFSQRQATLSEFILDIAWLLKEPASENLDHSFSVLEIQRFSSLLSFLMQHDSSTILEKILQRLDFLMENIELTSEISSGNNDADIRSFNTQIDQAREFLRKHQSSKRAVLHSEHSRRKEECSHQGFSQNDVLSAVTNANQDMEKGESYRVELMTGYTYSHKNEAAPLLDVELVMNGNLLKEKPRSRMLLSSVLRSRPTLFAVATVAVCFGVCAVLLHPNKVGEFAVSIHRSLFDRP

SEQ ID NO: 2133 - protein, 294 aa, Eucalyptus sp.
MGDLIEYVSPSPTQGGGGGGHGRPLPVREDCWSEEATATLIEAWGRRYVDLNRGNLRQKDWQEVADAVNARHGHSKKTHRTDVQCKNRIDTVKKKYKIEKARISSGGGGGGASPWVFFDRLDALIGSSSSSSSAGKKPSPSPSVSPLSPPVALPLPYKKTSSAVVAAVALPQKRPAERVDEGYFRRNYSEVAAAAAAAGVDDEEEDEEERDEDRDSEEDEGEGMRRLAKAIERFGEVYQRVEAEKLRQMVDLEKQRMQFAKDLEVQRLKMFMDTQVQLERIKHVKHSGSDDIYS

SEQ ID NO: 2134 - protein, 501 aa, Eucalyptus sp.
MDEQYGLPDLRQLIATRTTQFSSLLHLEPPLPPAPPPRTTIHTSFSPSSPPSSSHYEPTVNMLSTALANTNAHSAHPFATATPPPSALTGAFDIFECGSYRSDMIGAAGTSGISSSRWPRQETLTLLEIRSRLDPKFKEANQKGPLWDEVSRIMSEEHGYNRSGKKCREKFENLYKYYKKTKEGKAGRQDGKNYRFFRQLEAIYGESTTANRKPSSDNSSLVSNINFYPAPNNISSHAFQDQALQREMSLSFSNSSSHELETASSSENNEEDLSAIAFMMNSSHSSEKKKRLVSESDSSKRSKKGWKEKVKHFVDSQMRDIIEKQEAWMENMLKTIELKEQERVCREMEWKREETARFDCERELWAKQRVWIEARDTALMEALRKFTGQELAILSPPKDRNIAKEEERNTSSFSEPEILTLIQLITSLEPGFQECGLLREGFWELISAKMACLGYNRSAGECQEKWENVRNSFRKITEWNKKQREDFSRSQNLFFHQLHNS

SEQ ID NO: 2135 - protein, 340 aa, Eucalyptus sp.
MEILRPQNVDGVVGGSLKGKIRITTRCLWLDKGKLLDALHKAAHAALSSCPVNCPLAHMERTVSEVLRKMVRKYSSKRPEVIAIAVENPDAVLSHEIDNRLSGKSHVTFGFSALKKMVDSSPKKTKSSKRQVEDGNSHYYSEKYSERSSEGEDIEDRSFLHEENTPTTSSNAAKTQTASPSSDDLDDSWKSCLTSSSVDKLARDVNGSSQINVAELKSIEDGTESNGEDSLEMSTTQAKHSKPLKRNKWKPEEIKELIKLRGQLHGKFQVVKGRMALWEEISTNLLGDGITRSPAQCKSLWTSLVQKYEQSKSGERSRTSWPYFEEMDEILSVVEATTSK

SEQ ID NO: 2136 - protein, 412 aa, Eucalyptus sp.
MTPTKKTIPRQFSYNTLYVNPLTDARHVRSCSEGIALEGHSNHSPVKLGDHRKENAHPNQERDAADGDDKENAVPKSWSAAISKHSSNLKSLSTGKALNLKPSSLQFCMQMQDKDPNLGSKLRDPIGSENSHSVNIWDYSDSESAPASSWSTLPNRTLLCRPLPVDIGRCTCVIVREKSIDGVSGGTLYSLYTNEGKGRQDRKLAVAFCKRRNGKSIFTIAQSVKGLLSNGDDSYIGAVTANVMGSKYHIWDQGVSLDSVARGTKALLAVVTFVPTIATWTGSHRIMRAYIPKHQSMQLKNTTQVPHISGLPKDWEERRDRVHQLVSRVPHYNKISQQYELDFRDRGRAGLKIQRSVKNFQLNLEENGKQTILQLGRVGKSKYVMDYRYPLTGYQAFCICLASINTKLCCTV

SEQ ID NO: 2137 - protein, 267 aa, Eucalyptus sp.
MSTTATSTQGMLSQAAAPTMLEDQNLPSQLGFYSIFPSSMGSLASCSSSLCFNQTLKSLFTLPSSLVSPDPPSNSNNNNLTLITETLLSSTAPHKQRENLQTPSELLGGPQLLSLQRSTPNLWAWGELSDQSSLVMRSSSGGGDHGDHYRDHFHHQSMGVSALKMKKIKGRRKVREPRFCFKTMSDVDVLDDGYKWRKYGQKVVKNTQHPRSYYRCTQDNCRVKKRVERLAEDPRMVITTYEGRHVHSPSQDVEDSQASSQLNDFFW

SEQ ID NO: 2138 - protein, 345 aa, Eucalyptus sp.
MAVELMLGYRNDTTFSAKMEETAVKEAASGLESVGKLIKLLSHSQIQHPPAQEAPPLDLDRDCRAVADDAVSKFKNVISLLGRTRTGHARFRRAPVQSALDKLPGQHPHQPKIYYATPIQQIPPTPAPVPALPLGHYGGSAVISKSNGVVGERRDSSTTISFSDASFPFGSSLTADNISGNVNYNNVNERHVVVKQQQCSSSSTFQITSSSISGKPPLSSSSSLKRKCSSETLGSGRCASSSGRCHCSKKRKLRLKRVVRVPAISLKMADIPPDEYSWRKYGQKPIKGSPHPRGYYKCSSVRGCPARKHVERASDDPAMLIVTYEGEHNHSLSVVDSTSLILESS

SEQ ID NO: 2139 - protein, 222 aa, Eucalyptus sp.
MEGERGSSSSSVPNYDLQVTFSGASHGIHEIGFVPFEDQNQVLGFLTPAPPLMAAGEGATAAATTTTSRVGLGHHNGLVARSSWNNDQVGAHDPKAVSDENCSANPSEGNNSWWRSSTAAAEKGKMKVRRKLREPRFCFQTRSEVDVLDDGYKWRKYGQKVVKNSLHPRSYYRCTHSNCRVKKRVERLSEDCRMVITTYEGRHNHSPCDDSNSSEHEGFNSF

SEQ ID NO: 2140 - protein, 159 aa, Eucalyptus sp.
MSDSPNLRSPDSQDMDFNDQSDFELSEFLKIDEWLGDDPASMVHGAPANYFYQSNEADDSIGSSSNPEGPSRHAEGGKEKKEVKERFAFKTKSEVEILDDGFKWRKYGKKMVKNSPNPRNYYRCSVEGCPVKKRVERDRDDPRYVITTYEGIHNHQGPF

SEQ ID NO: 2141 - protein, 343 aa, Eucalyptus sp.
MEEVEEANRAAVESSHRVLSLLSQPQDQVQCRNLMLETGDAVFRFKRVVSLLNTCLGHARVRKLKKLPTPLPQKALLDNPIVRTDQSSKSLQLLPPNYPENAIQELNTHHKASLSLGNPNLELSSNGKSPLHLAQQAPSAHYHFLQQQQQQQKLQFQQQMKHQAEMMYHRSNSGISLNFDSSSCTPTMSSTRSFISSLSIDGSVANLDANAFHLIGAARSSDQNSQHKRKCSGRGEDGSMKCGSSSRCHCSKKRKHRVKRSIKVPAISNKLADIPPDDYSWRKYGQKPIKGSPHPRGYYKCSSMRGCPARKHVERCLEDPSMLIVTYEGDHNHPRVPSQSANT

SEQ ID NO: 2142 - protein, 985 aa, Pinus radiata
MSASKACFNTKCGATSTEKWRAGWILRSGEFAELCNSCGFVYEQMRFCETFHSDDAGWRICSTCQKPVHCGCIASVYSFTHLDAGGIECINCSRKSDSHTSASNQIQQMVPILSLSQKSVSPIKSSSKHIGGITVPGQWLQVPISGGSLTSQIEVTPTKNTCEFQRSDTIVLPVEKHDNGQFSIFGLKLTDGDIRKNSQIGEPKGEIPEGFSKRSSIHEERENGEDFCLDRKETCPRIFTEEGFTKRLQESELQIRVMGTNKFVQDEHYEPDVLKISKEKVCTMEAPASACLNVPLRPFNPKEISDNSSTLITGVDRYQCNPMETKEQNQGISTCSQLQQQCQFIPRPPDGSPNTDSQLGNGVRCQMRVAQIPSEGRSQNQLQTRYRPRITDQELQKICGDSNSIVKPLFEKTLSASDAGRIGRLVLPKACAEAYFPSISQPEGVPLKIQDANGKDWVFQFRFWPNNNSRMYVLEGVTPYIQSMQLQAGDTVIFSQLEPEGQIIMGFRKASNTTSKQEAQPSTTPNEASPNMGSDPGIFEKMSTDSNISEIPFHSRKRNRKSLVKALTSQISNAGFSLYRKEYKSRESSSFQSLLFRNKMQNHNLSSKRKRLQIDNEDALDLKVTWEEAQDFLCPPLTAVPSVVIIEGHEFEEYEVPPIFGKRTTFTTNQSRASCSVPHEGSSDDLEYLLHHSIDPRKKKDGKGQKGVDVSSGLDALANAATLGEKTTTSSIAATTRHPRHRPGCTCIVCIQPPSGKGPKHKPTCTCNVCTTVKRRFKTLMMRRKERQSEIEAENTRKKHNVVEEEGDVISGKKRLSDIDFHNENGLMKEDPDLTCKKRLTKVGNSIGNELKLASDVNLQAFCKDDKGGKEEYIVSKGQLDLNNQPDREEELDQRECDEQPSPEIGQTSMVNLLHDATLPLHMYLKQHGLPTLTYPPRINPTLQLQQTSGEERVEEQTSVQNEDHIKEEEFFPNRTQNDTHSIFV

SEQ ID NO: 2143 - protein, 410 aa, Pinus radiata
MAGAMQMRNSKPELFDNEDLVGVSGSSSCFSWADQEQIQMRLRGSNSARNVPEMSACAPTISGSWSELLMNGCNNAGDAAWYPSFQGSEANNQQQYAFVPDRAMDMGLQSMPSSQMGSSQLGVNSSQPLSISEIYEQIQANIQMQKKQQMDHLQLQLLLAKSHHSQQVLGSPAYHYQQQQQQLKQLRDLSLSRNLLGARAQPMKLSAKNDSKLGIARPAKLYRGVRQRHWGKWVAEIRLPRNRTRLWLGTFDTAEEAAFAYDTAAYQLRGEYARLNFPDLRYLLLSNSDNGSHNVLSPPGNALSVLKSSVDAKLQAICQRLSQENSSENRLMAHSANNEALENVKCEVSGSSNSSTICGAESASMSPSKCEVDSSTLQKAPSFSIFAELDECLTKMPSLDPEVIEDVLSS

SEQ ID NO: 2144 - protein, 214 aa, Pinus radiata
MAVDTMQMARAGLKMEIGGVGVGGGCEETAASAVKETHFRGVRKRPWGRFAAEIRDPWKKTRLWLGTFDTAEEAARAYDNAARNLRGPKAKTNFAIHDDSAALFNSGGGRAVPSQRQEWPSRPTFCSKQEPSEISNLSAIPAHPSVPGNDQVSSRVMENRAASTKRQKLLFGIHLLESSHNLQQEEDAVIYSSSRRQPPFLLDLNLPPAANDVD

SEQ ID NO: 2145 - protein, 189 aa, Pinus radiata
MKKEVDPAIVVKRSREAETEELGSKRFRGVRRRSWGKWVAEIRMLRCRSRVWLGSYHTAEQAARAYDAASFCLRGPAAFLNFPESPPAQFLPYPLRPLHDIHLSPQQIRTIAANYATMTPSSTSISTSTSGLQPQQSKPMDTSTLEEAGGEGSASVTTHVDSAKIGPRKMVFPNLNDTLDDEFGDFLER

SEQ ID NO: 2146 - protein, 256 aa, Pinus radiata
MDKEASSIPETMVTLATLSGASSKSASTVKSGVKRIPTQNRAASSSPQERTLKLKIPTYKGVRRRSWGKWVSEIKEPKKKSKVWLGSFDTPEMAARAYDVAEFYLKGKKQALLNFPEMIDHLLQPLSLSPHDIQVAAEEAAVAFYFSEQERKSPRNPPVSNEPPSSHQLLTVISSGFEATAVELPGEADTSNYSSSACTPTEGVGESESTVVEDDSFKSFHLFTNWAEAPLLSPRPLFMVHEEEHNLEEGFLWSGF

SEQ ID NO: 2147 - protein, 181 aa, Pinus radiata
MAVETMRMSRVRLGSCEDESRAVKETHFRGVRKRPWGRFAAEIRDPWKKTRVWLGTFDTAEEAARAYDTAARRLRGHKAKTNFSVTADDHNNAGAPALSWTQALHPQQPDLNAAAFAFVSNKRREVSSGSDRLEFESPNNSLHAAASEQAASSSPRRAPFLLDLNFPPTADQENESAAPWN

SEQ ID NO: 2148 - protein, 255 aa, Pinus radiata
MNVPVMGRTGGRSVLPKKVVEYKTVITKKFEEESLAHGGEFEGKRIPRRVKVISTDPDATDSSSDEENGDGSGQPLYSGRVKRHIQEINIELPDGLPSCSEIEREEFRWMKKSSRSNRRRQRIQAKPSSARLPAENEIESSSKYALRNVQKRDKKCNKKDDVFESGKKFKGVRQRPWGKWAAEIRGNDKGERFWLGTFETAEDAARAYDNAARKLRGLAAETNFPDTTTSATRHKRAPRTSKESKPSPITPPGYH

SEQ ID NO: 2149 - protein, 530 aa, Pinus radiata
MSSSSLRNNTVKGKHVATEPQRRRKVRSRNHGCTTVVETLAKWQELNSQVESSKDGAKRLRKAPAKGSKKGCMKGKGGPDNGRCNYRGVRQRTWGKWVAEIREPNRGSRLWLGTFSSAEEAARAYDQAARVMYGSCARLNLPDISASKESSVTSTSTTRVTCQSQECSTSQQYEVSSEWKDSKIHSALDTDIGGQVPSSQSPGVDAVYEAGVEERNDDRISETDQRYGSEMCLGVEAAQSDLPSKVEISDVVPDSALDLPVKSETNECTLPHILVPKDEPQDVDGKNAFDLSQATLLRFRDEPQADLPSAAVTGALSNSEVQPISIKGELNESAEPLDSFQDIQLQDLDEMFDPDELLNMMSGNDNKSELSEADTFNTLYFSSPWPQEQLLDGVLPSCDPSSSPTLQYLQIQSPDNRLLQNPILDEGEQLHLDDRNFKDLGQLQPFNLDSFQQPEYHVVKHVRLDDRQPLHPKVLDDGHFASFPYPYNNQGYQTEDARTRQVLSPEPMLTGGLQGMQDARMFQDIFPSYN

SEQ ID NO: 2150 - protein, 431 aa, Pinus radiata
MKRIAADGESQSCFVSGSGSTKPRVKRVRRCVPKDKSQNATPGRRSSVYRGVTRHRWTGRYEAHLWDKNCWNQGQNKKGRQVYLGAYDDEEAAAHTYDLAALKYWGTETILNFPLNTYAKELEEMQSVSKEEYLASLRRRSSGFSRGVSKYRGVARHHHNGRWEARIGRVLGNKYLYLGTFSTQEEAARAYDMAAIEYRGLNAVTNFDLSRYMSRLRPAKDIINSDGDDVVVSNGDDSGSSLLVPAGVPIETSNNTDDDNMSSLLLLQQPPQLSWTPPQLEEKESSSAAPEDPTDDLDHLFSQSSKFKEIMEIRSSGHGHGHKVPGVELEDLHNVETANFAEDLEMFFSNSSNMLGSDAELSLNVDSPGSAMNNNMFCQPDHLHLQMPFDMHDLCSGEFLDLDHHGQQPELEYPLIDPISSFPNFAVRTCS

SEQ ID NO: 2151 - protein, 279 aa, Pinus radiata
MACAPAVSDSPAENASPPFHLLLRVNNPTRMIRLDMKKLAAPYNPIACPCSALMITMDGTGRNFDNGADGIRNRDARPRTYRGVRRRSWGKWVSEIREPGKRKRIWLGSFQTAEMAARAYDVAALSLKGRSALPNFPDSVHTLPRPSSLNPRDIQLAAAQAAAELTQPMVSTDISSWQPQDQNLYDSNNNVNNDSVSASASDHDNHELSSVSMTSRDRFSLNEELLALHSPNWVMDMGCAGSDFLVSSPANCFNETDEYNYVLEPNGLDQEILPSSIFF

SEQ ID NO: 2152 - protein, 247 aa, Pinus radiata
MQSLFAESSEFMCSLKEDWLSVFTQNNDSEDHDLLMLLMGNNDSGHPQEILKQHPAPAEKREEEHRESAEGKRYSKHYRGVRRRPWGKFAAEIRDSRVRRWLGTFDTEKEAALAYDMAAFKMRGNRASLNFPVDVVTAALARGEQGSRFCSPYDEKFRRRLNGKRFKETTEPEEQPPLKWRRHNLDTEQIEQRAGWEDGQICNGPASEVLELQDLGADYLEKLLLLSCSSSSPSSATAVHEEEFVCW

SEQ ID NO: 2153 - protein, 479 aa, Pinus radiata
MASTSGSMQGIYVSSSMGMASNRNEDWWDIKAVNSQQSSSRLLEASTPRPSTNQAPSSYPRREDRPQTAESRVQAGNLSERDDSSSSLFHNNSSSSSSSSHLISFPAHYPQVISSISSSPSSSTLHQHGSEFFYLNQVTQAYPTHHSTHQAISFPQQQICFTNLQSPAQQQQLQFQSGFPLVSFNNQQNLQQQQYQQQLVRQWSDALNLSPRGQLMKHGKHHDRRGFALARPMKLYRGVRQRHWGKWVAEIRLPRNRTRLWLGTFDTAEDAALAYDHEAYKLRGENARLNFPHLFLNKGSTSPKACSVAAAPEEGNLQQKSDGGRNSTTSSTSTSALTANAAHQLGSPAAEGISDTAQAKSMDVEVKTDLDISAYEANTNLAPPAESGSEDFVKNEPQDLQFHTWPASPEYNIWGDLDENWLNSVPALETDMTWDVLFHNPIDSYVEGVDSDHKLETQGQASPEHHSPPQQMYVWKDCK

SEQ ID NO: 2154 - protein, 140 aa, Pinus radiata
MENFPDQEPDNAISLPHEDRGSRQFKGIRQRKWGSWVSEIRMPRSRKKIWLGSYTTPEQAARPAVRGRNADFNFSVPDIPTASPLSREQIQHAAAEYALGQAPSSFPSFAGQLSIMRFFGSFSGGFFWSKSGSNLLESQV

SEQ ID NO: 2155 - protein, 201 aa, Pinus radiata
MAITSQQHHMNALPYNERSEKRPKFKGIRMRKWGSWGSEIRMPKTRTKIWLGSYETAEQAARAYDAALYCLRGPNAKFNFPDTVPSIPSAFSLSRHQIQLAAARYARDELPSTSPSQHSNNINNGVSLASPSRSCRVSETELWSNSEQISEEQNFWASLLDSSECLNYQNFPSIDDTSTLDFIPTWQDEQDRYISLDLWNF

SEQ ID NO: 2156 - protein, 934 aa, Pinus radiata
MRTGFSQQHREGEKRSLNSELWHACAGPLVSLPAVGSRVVYFPQGHSEQVAASTNKEVDAHIPNYPNLPPQLICQLHNVTLQADVETDEVYAQMTLQPLNTQEQKESYLAPDIGTQSRQPTNYFCKTLTASDTSTHGGFSIPRRAAEKVFPPLDFTQQPPVQELVARDLHDNEWKFRHIYRGQPKRHLLTTGWSVFVSAKRLSAGDAVLFIRNEKGQLLLGIRRANRSQTVMPSSVLSSDSMHIGVLAAAAHAASTNCRFTIFYNPRASPSEFVIPLSKYEKAVYHTRVSIGMRFRMLFETEESTVRRYMGTITGIGDLDPARWPNSQWRSIKVGWDESTAGERQPRVSLWEIEPLTTFLMYPPPYPLGLKRSWPQLQGITSLYGSDDGSFRRPFMSERGDNGEQGLQTLNFQTISMDPWMQMQQRFEPSLSGIQSTAYHGMPTTVLQQTGNLNQSKQLKFQQQQPVQSEQLQCRPQVQSQRNVIEQQQQHQLQQQVFNLEQHQPQNHLLQQQLQQQTLQQQAVHQQLQNAINEQQQSSFQHQQNKQQAFQVPNVVNSFTQLSTSQSQSPLSDISSVTSRPVFTNTGATIASPKSSSSASPLQSILDSLTSEGASTYLSVPRPSQSVVQQPAETWSCVTQDQQVAAPWFSSKRMSTNQIPCLPSGQTEASLSTGSHRILSQTEPKSQTNVPAQSMPLPQFPLRDCPTEQEGVQSDSQSNLLFGVNIDNPTLAISDTVSSARNVGNGAYVASSFSVTDLLNVPPCAPVSGFSMNSNMGVSGGLDESGFSQPPPNFAKMNAPTRTFTKVYKLGSVGRSVDVTRFRGYPDLRAELDRMFGLEGQLENPRSSWQLVFVDKEKDVLLLGDDPWEEFVNNVRFIKILSPPEVQQMSQEDMEFWSSIPTQQQTSSSSEDCVARNSSRNISSVLTSTGSLEY

SEQ ID NO: 2157 - protein, 934 aa, Pinus radiata; identical to SEQ ID NO: 2156

SEQ ID NO: 2158 - protein, 942 aa, Pinus radiata
MRLSSSGFGQQPPEGERRCLNSELWHACAGPLVSLPAGGSKVVYFPQGHSEQVAASTNKEVDAHIPNYPNLPAQLICQLHNVTMHADVETDEVYAQMTLQPLNAQEQKDCYLGSDLGTPSKQPTNYFCKTLTASDTSTHGGFSVPRRAAEKVFPPLDFTQQPPAQELTARDLHDNEWKFRHIFRGQPKRHLLTTGWSVFVSAKRLAAGDSVLFIWNEKGQLLLGIRRANRPQAVMPSLVLSSDSMHIGLLAAAAQSAATNSRFTIFYNPRASPSEFVIPLAKYVKAVYHTRVSIGMRFRMLFETEESSVRRYMGTITGISDLDQVRWPNSHWRSVKVGWDESTAGERQPRVSLWEIEPLTTFPMYSSPYPLRLKRPWPQGISSLHGIKEDDGGINTPFMWMRDDGGDRSVQALNFQGMGMNHWMQQRFDSSLLGMQPDVYQAMAAAALQEMRSVDPSKQLLQFQQQHHLQPQQFQCRSSPQLQRHIFQQQQAPQQNILQQQAQNLQEQSPQNHLLQHQLQQNSSQHHLLQQQLQHCFNDQQQPLSEQQQCQQPFQVPNVGGALSQIPSSQSQPAITLPSSMCPKPLFADSNGNLSSAMTIPTISTLQNILGSSSGGENSNYLNLPSTSSVVHQPVGMLTGHGIPRDCQISSTSWVQKLLSNNLVPCHPGGQVEHLPSGGQCVVPQTESLGQSNIPSSSMPMSLPQFASRECPPEQEGIHSDSQSHLLFGVNIDSSSLIVPNTVSNMRSIGSSTDAVMQFGVSNYLNAPPCASGSNISLNSDISASACLDESGLLPPAENLGQMNAPTRTFIKVYKQGSVGRSLDISRFSSYPELRSELARMFGLEVGQLEDPLRSGWQLVFVDKEKDALLLGDDPWEEFVNNVWFIKILSPPEVQQMTQEGLELLSSFPTQRQASSSSEDYVTRQDSRNLSSAITSVGSLDY

SEQ ID NO: 2159 - protein, 896 aa, Pinus radiata
MRLSSSGFSQQSQEGERRSLNSELWHACAGPLVSLPAIGSRVVYFPQGHSEQVAASTNKEVDAHIPNYPNLPPQLICQLHNVTMHADVETDEVYAQMTLQPFNLQEQREPSSLVPELGAPSKQPTNYFCKTLTASDTSTHGGFSVPRRAAEKVFPPLDFTQQPPVQELIARDLHDNEWKFRHIYRGQPKRHLLTTGWSVFVSAKRLVAGDSVLFIRNENGKLLLGIRRANRSQTVMPSLVLSSDSMHIGVLAAAAHATATNSRFTVFYNPRASPSEFVIPLAKYEKAIYHTRISAGMRFRMLFETEESSVRRYMGTITGFGDLDPARWPNSQWRSVKVGWDESTAGERQPRVSLWEIEPLTTFLMYPPPYPLRLKRPWPQLQGMSSIPGINDDDCKMMKSIMWTGGDNGEQHLQGLNFQGLGMDPWMQMQDRFDSSVAGVQPDMYKSMAAAALQEIRSVDSSKQLLQLQPQQPVQSQQLHCVPQPLVHRQIFQHQQYPQHILQQRAQNLQQQQQSQQNIHQQQAQSTQQQQPHHHILQQQALNVLPQQTPQHVTQHAQNVQQQIQQQSSQHQVLQQLQQSYVEQKQSTSQQVQCQQQTFKISHVAGALSQTPVSLSDSPISLPSNVSSQPVLADSNANIASHASLSTACPLQSILHSLASDESSHYPNMQRAIQPRMPQPSRNLTGPLSQDRQAASASCHSSRRVSNNQMESCPPAGQVESPLPSGGQSIVSQTQPTGLSGGLDENGLLQCTPSLSQLNPPTRTFTKVYKLGSIGRSVDVTRFSGYHELRSELACMFGLEGQLEDPCRSGWQLVFIDKENDVLLLGDDPWEEFVNSVRSIRILSPPEVLQMTQEGMEWLNSISVQQQTSSSSEECVTGQDSRNISSCITSDRSLDY

SEQ ID NO: 2160 - protein, 950 aa, Pinus radiata
MEIDLNSPDEYSNGRLNSSEELALSKSSICMELWHACAGPLISLPRKGTLVVYFPQGHLEQASTSLKQQQMRPYELPPQIFCRVLNVNLHADQETDEVYAQVTLVPEPEPLEDAVGDKEEEDEDVLNKPTPHMFCKTLTASDTSTHGGFSVPRRAAEDCFPPLDYTQQRPSQELLAKDLHGVEWKFRHIYRGQPRRHLLTTGWSVFVSHKGLVSGDAVLFLRGENGELRLGIRRATRQKSGILSSVLSNQNAHLSVLAAAASAVATKSMFHVFYNPRTSPAEFIIPYQKYVKSCKQPLSIGMRFKMRFETEDTAERRYTGMITAIGDADPARWPGSKWRFLKVEWDEHAANEQQERVSAWEIEPSIAGAGLNVSSGTRTKRLRTTLLSTPVDVAIPDGSRLSDFEESVRFQKVLQGQENMSFKAPSRNDGVGFMKCPILERKGCNAVAEGFETARTENAIWSSLERSDISSRLLDFGESIRFQKVLQGQEILPSKASLTSAGVDLMKFQHWDCKGYHAEGSEGAMHGHKSWPSLGRPNVAPFSDVLSNKGKFGNAYGSDKIRSVEYSCEQFSNTNTPHLKVFTKPHSGGNHATCTVNSQNLATIPRASPLSSIFGSRTRNDSELCVQGTYPMCRMNVFQKNDLYGDYSQTFNRDLSAQFDIPKMAVGWQASSVSHCDSDNTQPAGYTAGLSSSEPSKKQEKLIEVFLKQHQLPIGFHSTETDRGEIQGKQSCKLFGFSLIEEPACMDDVISSSIPHGDITQEGLPAIYGHGTVHSSISQNQDNLLKSSADRSGPPEALKGSAQQKTFQAVSGLSTLVQTPGRRRTKVHKQGNVVGRAVDLSKLDGYDQLICELERLFDMEGLLNDPKKGWQVLYTDNEDDMMLVGDDPWQEFCNIACKILIYTHDEVQKMTPSMFSDDANSSEEQPSTVEVSKSSIDNQDSSSPLMTGNQ

SEQ ID NO: 2161 - protein, 950 aa, Pinus radiata; identical to SEQ ID NO: 2160

SEQ ID NO: 2162 - protein, 934 aa, Pinus radiata; identical to SEQ ID NO: 2156

SEQ ID NO: 2163 - protein, 867 aa, Pinus radiata
MPSQSTNSTQNSFSGGIGTDASESLLYEELWHACAGPLVTMPRVGERAFYFPQGHIEQVEASTNQGVDQHMPLYNLPSKILCRVINVQFRAEPETDEVFAQITLLPEGDQNESSHDSGAAPPQPRKSNVHSFCKTLTASDTSTHGGFSVLRRHADECLPPLDMSQQPPSQELVARDLHGMEWRFRHIFRGQPRRHLLTTGWSVFVSSKRLVAGDAFIFLRGESGELRVGVRRAMRQQTNMPSSVLSSHSMHLGVIATASHAVSTRTIFTVYYKPRTSPSEFIIPYDKYMEAVNSSLSVGMRFKMRFEGEESPERRFTGTIIGMGEVDNVRWPESKWRSLKVQWDETSVVPRPERVSPWEIETFVASSAALNPLPAPRTKKPRPNLVSSSQELMIHGSGKTATDSSQVHRLPRVLQGQEMRTFGGSLGDSEVESSQKPLMWGSSVDQKQDSVGSRGRLASEYWVSQCRQDTVYSDSYSVIQGARDTQQLCGPTACQNMEIFQRLKPPPKQFQDEENGIIDRSGTKLQLSSSWSVMPSDNPHELTESDLKLSVTSNPSHKQAGLGKWSGLDPPPLLSDVGSKESEGNWFVSLISQPQVDFSGTHAPGQLERNPARSHGTSNLGMAVQQSTLQSREMLEEKGVLSGARSADCKLFGFHLIENSVGELTPSTIRGLAAGEDIHVSVPNITVHEAQSESDPHFEPSSMAKMDMPAAITDEEKSSQKSSKETHSRPQTNSTRSCTKVHKQGSALGRAVDLTKFEGYTELIRELEQMFNIEGELEDPSKGWQVVYTDNEGDMMLVGDDPWQEFCSIVRKIYIYTREEVEKMTPQTPSAKLKGCSEEPVTRETSRSSDRQDSSIAGVTAERSSDA

SEQ ID NO: 2164 - protein, 539 aa, Pinus radiata
MNMGEHFASSPQILSLFPQNPIVMEEQRDVQGSGSMQNGSELAEYHLGSSMGLFQGYPYSQQVYPSPLAEHEALLANRTYFCALFNEFHAGLGTSLTVPNIGGEELDLHLLYRQVTACGGLEQVIKERRWKEIATALKLPSSIITYSFVLRKHYIDLLYHFEQVHYFGARGQLAPPPGPLPAPRPSTKSMDNGITCQLLVDPKQPAKKRKNIVDPAQLFGVDPGAYVGQTVTGAVDQRFENGYLVTVVVGSEKLKGVLYHVPTETTVQQYAVVPGLMSNVGCDALGLEVQVTKKRKERVHNRDPSAPRLSKNGYKFFYVEQCSRLKKTYAQTDREIVKTVNDLWNKLSDNEKMQYIERSQQDKKRSKTQMMAYKERIKLQERSEGYNGDKTSEVVGPKIEGNVTAPFFHDNSYDYHVSLEAGADANSFHSHQQRGISSEVSGIPVADHGAYSGEGDKSVYSVCFPPPEISAPNFGGSSLPQTYVGSSDQFFYQTQSSAFQSSFMPYSMTPDQIYWMQGGQSFNSQDGQTLSLYPQNPFI

SEQ ID NO: 2165 - protein, 366 aa, Pinus radiata
MQMQVFGGGGGDAHQVYPEPLATHREVVADRDLFLATLIKFHAALGTRLSIPKIGGRDLDLHYLYKEVSGRGGLQMVIKERKWKEIALALDFPPTTTSASYVLRKFYSNFLHHYEQVYLFGVKGHLVPPPAPPANPCPPAHSSEVEHMQSTSEDPEPEMRKRKIDSAQALGVDPASSIGSTVMGSIDGKFEHGYLITVMVGTRKMKGVLYHIPPTGARPQGASVSTFMNNIITGAEALQIENQIGRRRKKKEMSRKDPNAPRQNRSGYTFFFAEQRAKLKSTEPDKNREISKMIGDLWNHLPEDKKSPYQERGLQDKERYKREMREYRERIRFNGEQVVDGANLHQTGLHLGRNDNVTKNDVCDTA

SEQ ID NO: 2166 - protein, 557 aa, Pinus radiata
MQPQAQEDPPQEFHEYPQIQFPLGSMGTLEVPKNHRKMPFEGLSLFPENTEQIGEEQNEQQLGRGHVEEVEGQQQLATSGYHVPPGINIFSPPIAEHDTLLASPDLFEEALGTFHGSLGRRLTVPHIEGQELDLHAFYREVTACGGLEQVIRDRRWREVARALNFPGSIINPSFVLRKHYIDLLYHFEKIYYFKAHGQLPYPPGPLPAPLPIVKSIDDKIAYQIPVGSAQSVKKRRKIDPTQLFGVNPGASVGHITTGAIDGKFDNGYFITVVVGSEKLHGILYHVPTENASPQFATIPGLIRSVGSELDALGLQVQVNKKKKETPSKKDPNAPRPAKKSYNFFYAEQCARLKKNHSQTHRELARMVADLWNNLSDNEKLPYIEQSRRERERYKREMEDYKKRLRVEAHGEVNIGSDTVDVVGQENEGPDVNTFYQDGSHDYHVSLDTDADMNSFHMHQQQEADVPVAEPQIYSNQADGDVYSVVLPEPQVSEFQLETSGCLTQTYGASGDGYSYQNATLLPNVCQPGFVSCPMSSDQVHWVQEGSHPFCVQEDPQV

SEQ ID NO: 2167 - protein, 459 aa, Pinus radiata; identical to SEQ ID NO: 1327

SEQ ID NO: 2168 - protein, 322 aa, Pinus radiata
MNSFNSREFSQVVQDYNYRALHAASKGIASGAKRGFSDALGVNLMRDSGFGLPESDSKLLNQSQPRNFIFPWAVPQQYGPANAWLTWEQKSKQNLQHYSKALATSGIPDDKTNNRFGEGAISTQNTQSVVKASQESQRPPAPVAASEKIQTPAEPDRAPNQSGTPSRAPPVVGWPPIRSFRKNLAAQPKVAAAPSCNPPPPAADQGEKKINTMFVKVNVDGVPIGRKIDLKAYDSYEKLTVALDEMFRVAINAQTSDANPLPENNNNQASLLNGRDYVFVYEDNEGDRMLVGDVPWDMFVKSVKRLRVMKSSDVRRLANRTQ

SEQ ID NO: 2169 - protein, 836 aa, Pinus radiata
MPWAGRNSNPVRPPPGNEEGGLCNRIADKSHKELPRPNESLFCQQIDLKDTMNHCVPNWDMENGIIQSSDFPPMAKVNWDYVQPQKRSTMLEHDIEELLWENGQVVNKVVKRPFPTQLSKTLQNDDAVLPGKPSPVGKDNTLESVVHAMSSANASSIHEDVMDSWLHYPLDDSLEKEYCSDFFVGIPGTNVHMLRDSLSGQMNNVPAEKVSNLHAQKESSLSSENNSAPWTGVFAGMVNGTNAAGPSKTGKESPPKSIISDKAMALGAGRASGIISQSGTDTFAKVRTTNQLPVSKWHTDVQGSSSSNDDQPPCKKTATQLSSSPLSMPPPKMQATDLASMKPSRTKLVNFSHFSRPAATMKANLQSIGSASGLSTTGIQNRLDKIRMDGNAAAEPSIIESNSTGMTTIGSSSGANSQAQDIGSCQTHQNPPVGKNLDVATCSEDVTDSSPKVSEQVLRQNSDAGRSLASCGTEKCGDAGDGPEPTITSSSGGSGNSAGRAGKEATNTSKRKSRDVEDSECQSEDVEYESAEAKKPAPSRTTTSKRSRAAEVHNLSERRRRDRINEKMRALQELIPHCNKSDKASMLDEAIEYLKTLQLQVQIMSMGGGMGMPPFVFPGGMQHFQVPQMAHLSPMGMGIGMGYSMGMLDMAATSGRPVMSLPSMHVSALPGSTIHCQAALPLSGMPGPSLPMSRLPGPGLQVSGLPVSTLPVSGLPGTTQPGLVSTSASGSTDLQDHMQNANVMGHYKHYMNHHQMQGLPQVLNGNLYNSSMAQPAPQNPVQSDGRGAHNTVSASGKAGTTGKHYDLLFFLFVEKMNFYITLLIRNKFTSFATSES

SEQ ID NO: 2170 - protein, 251 aa, Pinus radiata
MDARMQSHYYEDQHSQMWMDEFPGHLDWDDSDPEIMQLSKPANKVNNYVVEAAASKNLHSERKRRKKLNDTLYTLRSVVPKISKMDKQSIIGDAISHVLDLQKNIQEIEGEIKGLCSSNEGDDDTQTPTDIKKPLTKPSLEKRCTESSDAKKSVDKFKVKRRKASETKIVEICKAGKDGIYQVRIECKKDAGLLVDLMRALESVPLEIVNSNLCRFHEAIHGTFYVRSLKNVGADELEDMIRQTIASDCSS

SEQ ID NO: 2171 - protein, 254 aa, Pinus radiata
MDTRMQRAGEVSKCHYYEDEHDKLWMDEIAGHFEWDDSDPQIMRLPKPGNKVNNYVVEAAASKNLHSERKRRKKLNDTLYTLRSVVPNISKMDKQSIIGDAINHVLDLQKKIAEIEGEIKGLCNSNKGDDPHIRTPPTKPNLEDRSATESESGDAKKWVNKLKDGKVLEAKIVEINKAGKDGMYQVRMECNKDASALVDLTRAVESVPLEIVNSNICRFHQAIHCTLYVRSLENAGAHELGDMILQTIASNCST

SEQ ID NO: 2172 - protein, 412 aa, Pinus radiata
MQNGGMTLAAQMEERKSRSLSDSWAKLLDTGTGLPDHGVSVINHATLWDHIRTPLYGMESSSTSTAEIKDCWMNSPAGNDVSWPSNEVKILPSSQHSRQIAEQNRWIASSSPFCSSSNNNNNNNKTDDNKSNNNNAHGNREAFCYSDGNAGKFLFRPDAFPCGPFTKLLDPTNTLPPDSLDLELEGFPASSKVSIPLVQLPGPLKAPATFPSSNILTFQSNMNKLDMPYTSPSPKPVGPVIVQQQKSGGSPSSSPSTSSSNNNLQKNAVDEGGECTTEQKRSSDQAGLSNAAFKKPRTEASAGPPMKVRKEKLGERITALQQLVSPFGKTDTASVLFEAMGYIKFLQDQVQVLSSPYLKGIPSSQKDGRGDQAKYDLRSRGLCLVPVSCTLHVANNNGADFWTSGIGSGSKF

SEQ ID NO: 2173 - protein, 600 aa, Pinus radiata
MLSRMNVNGGMWGLEDATDLHCNNDENLNLPTFKAMLDAEEWFTSHSNTNHNDIATASINNANSHPEGPCFNIDMKDFGCYSSLVNPNPEPPNMLLQHAMNSCSSSPTSIFSLDPSQVQSFLAGGSHHHQHHLHHHHAPQLSDVVGSSPFQELACEGLVSSNNASSNSSSNSYLYGGLSGGIFRQLSPSFAGSSPRTNAATPTPNLSSPHSQVGGSITSNLSPRMMPASNLNLSDTGLFAGNNHNTNNSNNNLSNLLGLSSLVSPRLPAPLNFSSPKMLRPLEICAPVGAQPTLFQKRAALRHTSLSPCATTPCIEVLDEESPNGNSNSNVKGKRKLMSVGADKKEEEDVDESNDGSGVQYDSDDVGGNNNSSYKVDQIGEDGLASAGGTGNAAAVNNNSNGGGDKGKKKGLPAKNLMAERRRRKKLNDRLYMLRSVVPKISKMDRASILGDAIEYLKELLQKINDLHNELESTSQGPVLPGTSNFHPLTPTTPSLPCRVKEECPTSLPSPNAQPARVEVRMREGHALNIHMFCARRPGLLLSTMRALDGLGLDVQQAVISCFNGFALDVFRAEQAKEGEIAPEEIKAVLLHTASCHTAI

SEQ ID NO: 2174 - protein, 636 aa, Pinus radiata
MGAETAAALKFWNDEDKDMVKAVLGPNAFEHLIMSFLSCEGLVAGVSDSALQQKLQFLVEFSSSITWTYSIFWQLSRSKAGDYVLGWGDGYFKEPKHGDEMTRRFNESETEQRMKKKVLQKLHIFFGGAKDDDFAMGLDNVSDTEMFYLTSMYYSFPRGVGVPGRALGSGQYIWLKDAHRTSNSISSRSFVARSGGIQTILCVPTDNGVVELGSIDSIKENKEFVQMIRSIFNDHRVQQLGHSRGSALSQSPARVPDILPLSREKEGHARAVVPFKLFEYGDHQKAVAQDYSKVFGQDLKSGKTRTLVDHKFVSSKMESRFLHPVFRAPNEHQHEYYLNDDKIFYGSNKKGFQSITLNQVCNSKGGDIYNSRHDYHQQKQEIGFVIPNNDIGSQHVHHNNFKCSKEENKIKEQQHQQQQSQMEFSGTSSIVSFRPCMAESEHSDAEASCKDDKSPLVDERRPRKRGRKPANGREEPLNHVEAERQRREKLNQRFYALRAVVPKISKMDKASLLGDAIAYIQELQKKLKDMEKEKETQENTSHAPSVAPQNMLAVANTNSIPDVDVQTVNGDAVIRVTCPRECHPVARVMLALQEMQLNVQQADMSTAKEMILHTFVVKLNGAQELTKEKLVAAISG

SEQ ID NO: 2175 - protein, 583 aa, Pinus radiata
MDTFMASSTSSAVDQGFSQETLQQRLQILVETASIVWTYAIFWQVSYDSSGAIQLCWGDGYYKGSRNAEEDERLRMRSRLTVSPAEQELRKKVLRDLHSMISGSDEVNQQDNSGVSVDEEVTDAEWFYLISMMQSFLSGFGVPGMAFSSGAPVWIVGAERLQVSNCDRARQAYELGIQTLVCVPIQGGVVEFGSTEVIVENWLFLEQVNNSFKCNLNQMHDNPFQIQSLWPAETLSVKSSNTMQSAQCIEPVSNPEIQSMNSALARELPVTGKQKASVFAEHSSLVVTDDKPLLQTLTQETEAFEAPAIHIAETVGPQTRTLGFKGSEKNEIKPAIKEDTIGLPSNPPGIVIGGLRSSIESELSDVEPSASIKDSTSALVERKPRKRGRKPANGREEPLNHVEAERQRREKLNQKFYELRAVVPNVSKMDKASLLGDAAAYIKDLFSKQQDLESERVDMQVQIDTIKKELLMNSLKLAAKEAKDLSSIDLKGFSQGKFPGLNSEVRIVGREAIIRIQCTKHNHPVARLMIALQELDLEVLHASISTVKDSLIIQTVIVKMTRGLYTEDQLHALLCKKVAESLN

SEQ ID NO: 2176 - protein, 320 aa, Pinus radiata
MMAQRLDILGGNDSSISEHQQTNAHSDLTSKDTVNHRKRKCLSNPKVKVADALSIPLKIKETNEAERNGKHYKVGESTKDKDDLKDKLEECNSAETAESCPKQTVDNVKPSSVPVKQDYIHVRARRGQATDSHSLAERVRREKISERMKLLQDLVPGCNKVTGKAVMLDEIINYVQALQCQVEFLSMKLAAVNPQMDYNVEGGYLTRDVLQPHCSSVSKMFAPETTATTSQINQLQKTPLQHGMQCRADRQEVAIRGMMDTQLTCMNGYADPTFQLQMSQGWDDVFQNVVDIGLDQNRSTSLKSHGFHGLLPTGHMKVEL

SEQ ID NO: 2177 - protein, 522 aa, Pinus radiata
MGNLADWPSADVCDMTPNSACDVNVVAGSIPTVSSDLNMAFTNLGRPELGDSASLLDPTAQMGAFATALHDQSHVWSQAMLNRGGESMQNAVESFQDVLYSRQNGSPQKLKELEDVSAGWELRNFTAFQGEDTSCFSTAAKENSYGPLHNCNNSLIDLGSSPSLQPDGLTPGHVPINSFNSRLDLPIPHFDIGRVKQEFNMSYDNPGLDAPRTLVSQGFRSDPCSNEELLRILDFPMNQPFLKGATAHGFHNATSMRGEDHHQQPHGLWPSSNTYSSRTFPAALSRLLPSSPLKQPASRLLTNSRNIPLWNSMASTPEKMQQSTNSTDRASSLQYCSPQFLQEGKQLNNTTQSLNMPRCDEARDATNDAKRSSPDSSSSDSIFKRPRLDNTNSTLPTFKVRKEKLGDRITALQQLVSPFGKTDTASVLWEAIVYIKSLHEQVQKLSMPYMNKGAVNSAQGVNLQAHDQMDWSVSSEAEDTDEPKQDLRSRGLCLVPVSSTLSVAYNDSSADYWTPTFICSYR

SEQ ID NO: 2178 - protein, 583 aa, Pinus radiata
MDTFMASSTSSAVDQGFSQETLQQRLQILVETASIVWTYAIFWQVSYDSSGAIQLCWGDGYYKGSRNAEEDERLRMRSRLTVSPAEQELRKKVLRDLHSMISGSDEVNQQDNSGVSVDEEVTDAEWFYLISMMQSFLSGFGVPGMAFSSGAPVWIVGAERLQVSNCDRARQAYELGIQTLVCVPIQGGVVEFGSTEVIVENWLFLEQVNNSFKCNLNQMHDNPFQIQSLWPAETLSVKSSNTMQSAQCIEPVSNPEIQSMNSALARELPVTGKQKASVFAEHSSLVVTDDKPLLQTLTQETEAFEAPAIHIAETVGPQTRTLGFKGSEKNEIKPAIKEDTIGLPSNPPGIVIGGLRSSIESELSDVEPSASIKDSTSALVERKPRKRGRKPANGREEPLNHVEAERQRREKLNQKFYELRAVVPNVSKMDKASLLGDAAAYIKDLFSKQQDLESERVDMQVQIDTIKKELLMNSLKLAAKEAKDLSSIDLKGFSQGKFPGLNSEVRIVGREAIIRIQCTKHNHPVARLMIALQELDLEVLHASISTVKDSLIIQTVIVKMTRGLYTEDQLHALLCKKVAESPN

SEQ ID NO: 2179 - protein, 580 aa, Pinus radiata
MDQVTDGSHSAQRLLYSLQQPQEQQSEVTLLPDNPDNMNAMDMCMLDRQRKGPNAQPQLNWPQQQQFLRTNSNSEQIHGPFISLLKTSEMLSDGIITSEWQQLAEQNGHLLPANPGYAMNLGGSMSCQESALRQTLSRSMSSPNGPLNLHTDWSNLSNNTKTMYGVENEAIGRSVLKAPACLGPFPSDPGFTERAAKYSSLNGKNWNARLLTSERASVGEMETSSLEFLSDVARNEPQVACSNDSESKKAFCRTASCPPTVENAAAETEKSSVLVEESAVSEKSSAGDIKTSNNNAVKKRKSGRNSAQNHRAADSEESKEKRTKAVHSGDKEKEDVMAKTEQCNSDNSVEFSPKPARENPKPLENQKQDYIHVRARRGQATDSHSLAERVRREKISARMKYLQDLVPGCNKVTGRAVMLDEIINYVQSLQRQVEFLSMKLAAVNPSLEFNIDNFLAREMMMPIPPPGNFSSLEGMSPNAAPYIHIHQMLQQQQQQQQASLQAGACTGLDVPTLDTSTSLHRPGSAEMFADAANFQGHAPSTWDSELQNVFSMGLVQDRQPPFPSEGLPGHLEPNHMKMEM

SEQ ID NO: 2180 - protein, 350 aa, Pinus radiata
MDSKMFQLDQMDQFGLEPADMNTFNMTAVSPEELLQLDSACPSLFGGLMQFDSNNKHNNSDSSPCQSPDGPVFPAFEGLNFCNNLSINTNYVLQRGNAAGSCDSINDTDTNSNISPAGSEDLRKSNSCNSSEATQDHKKVANLDLVLDLDLDMPAVHAAPAMAQVQPRFNYFPRLQGSMNTDPAPHNEGNNNGMGAMREMIFRVAAMQPIQIDPESIKRPKRRNVRISKDPQSVAARHRRERISERIRILQRLVPGGTKMDTASMLDEAVHYVKFLKKQVQALERAHHAKAPACWTSNSFSQGALINPANISNLNFSAFNSMTNPNLSNGLQFSAVTSNTIMPLDRSGVS

SEQ ID NO: 2181 - protein, 591 aa, Pinus radiata
MVCIPTPNGVVELGSMDLVCENWALLQQAKNSFTFSSNPWEDNGNGNFSNNNNHNNNYGTNNQSLWVPGSPFLTQESILGDLSFLNNEENHNRNSSAQKPPSMIEENRNPLPPFTAQKQVAMEENRVPLSFPTQKSAVLDERTSFNLVQKSGISEAAHNPLPFLPKPPPVGGFDEKSNPMAYSTVPKPAIIDENCSSLLSQKSSICSEILNPFPYVAGPKSIDFSESCNSYTVPSLQKTSIESSNQNTLQSAAVQKPNIADQNGNPNPNPNQLLFSVQKTCVSDQSKAFSRDLLLEDDKPKPLLNIQNNNSQRHTLSFSNGYSQNLVEEKMVKPLSIDDEKPNSLPTISSGAVFGGVRSSVESDHSDVEAASFKEANQAVIEKRPRKRGRKPANGREEPLNHVEAERQRREKLNQRFYALRAVVPNVSKMDKASLLGDAVAYINELQSRVQEIEAEKKELQAQIEVTKKESSSSHSAFSGTNLGFIKDQSGSSQKPDVKRFGTKECSAIDLEVRILGPEAMIRIQSAKKNHPAARLMTSLQDLELEVHHASVSTVDELMLQNVIVKLPSSLYPEEQLNAVLLKKLSDPKFK

SEQ ID NO: 2182 - protein, 714 aa, Pinus radiata
MELPQPQLPFEGSKPPHDFLSLYGDSSSNRVEHRSSQANSTHLKTQDFLQPLERGGKNSNTKGLEVSSAETSAATPASSVEHVLPGGIGTYTISHISGYSQMNGKSEIPVVHVNVAETKPEVTRAASSTNYGGGAFTLWEERLRVVDGNRTSDGPATSDFSKEYLEKSGYWPAVRAKADLSFPAKTAFSLSSVETSQQQLPSSSKQRLQTGPGFVEMIKSIKTISEDDEDEEDEYVDRSREGRKEGSSQKGDPPPKADGRSSDQKANTPRSKHSATEQRRRSKINDRFQMLRDLVPNSDQKRDKASFLLEVIEYIQVLQEKVRKYETTEQSWNQERMKTMVWDLCKKSPGHGEVPVDGSRIGVGIPSDSKQNNEVGDPARSKVTSNALRYENGTAGADVHPTSQNLLQPNKPTPVIPGCAPSYKEKENIGAFNKSIPPTLSMQQCVYSPFGRSYIHSANPKGQATSEIHSLQGIQGMTPMCIPANAYNFDKEKDVDTATPVQLSHFQGNTVTVAKTTSGHESQWSELRSSQVSPIQQYSGQNGGILLKDEAADTKSASKSENQHSSAYLNSSPRLSQYVPQSEAELASRQPQPPCSSPDQQRASEARPATSEQEELVIQGGVINVSSVYSQGLLDTLTQALQNSGLDLSQANISVQIDLGRRGGTSGTTTNIKEHSHNHEESSQNHQLHGQSRAAETSSECEQPPKRPKIERDV

SEQ ID NO: 2183 - protein, 580 aa, Pinus radiata
MLERSGSLNIHLAAPQERLRSLVGPKRWDYVIYWKLSDDQRCLDWTGCCCSGADQSGQGLQNPSPESHLFFSPRYFEGGSCRDVMFQHPKCTTCEILADFPTSIPLDSGIQGQVFLSGQPRWMNFPNIGDPDAGQEAVQTQVLIPVRNGIVELFVSKPVAENAALMQFVFTQCDPWLPQMYDTNNLFGASPAPSLGGCGFGSVSEAAGTLPWLPAATGDSSVPWDAERALSESQLSIHMVTPHLNFLGQQLQPQVAASGQIKQKNDFYEGSADSINHAEKPPAMHMDPVSLQDIQQAGLPMRNNSLPRGHGLTESPHTSGLSKEVQDKDVKQEISRADSSDCTDQMEDDDDQKAAGRSGRRHLSKNLVAERKRRKKLNERLYALRALVPKITKMDRASILGDAIEYIKELQQQVKELQEELDEIDVQAGNPTTPPNLENGGQTTLDEETHARCAAKTDLTKGPGNATEETVQTMQIDVNQVDAHVFNLRIFSEKRVGGFVKLMQAMDALGLDILNANITSYRGLVLNVFNAELRDKEVVQAGAAQLRDSLLEMTLHPDILRTGEGTAASDHQQRHIQQTT

SEQ ID NO: 2184 - protein, 284 aa, Pinus radiata
MTSNMSDPSWLHSPFFPYNDDGNKFDVESVSSNSNPFLSIYNADHHAHGFNSSESHKSETLAVLSNPPLLQTICNSSPPSDGQACTRLPGSVPAGKNNHKMIERQRRKEMKVLFSRLRSLLPEENIRGKRAASEQLLEAVNYVRYLQQKIEDLSAQRDKQKVNSDQNAKVSFRKFCNKTQPFGGSDRECPAVNIKSVGSGVQIWTNCLEHEIVYSEILLALEDGGLEVVSASSSAVKNRVYHTIHAKVFDHSTFNIENLYQKLWHLINAHHNKNQDLRITEARA

SEQ ID NO: 2185 - protein, 441 aa, Pinus radiata
MSYVKMLNSRAQPISTGLSIPSLSVGHTDVNGIQISFSQYPMDSEKMPQMQQQTNNVDFMDLDYKPPLCNVSQADGVMALTERGSSNNFQGPTGLMRYHSAPSSFFSSLGEEENNNIISEYFSGNSSNPLQSNTKPLQQNQSSILSFHLRENEPAKHLGERNEYLKRNARQLPSLKRSAGNVSREDLGKHHPLDAILENVPDVSQDSFGTSQMSLMSQVQVSEPSGQHIDSSYQMNSVCCDTLDQSGGRMGNAYSSTSKNTLIRHSSSPAGLLSELVAEGRGTFESGMQNGANFTARKRAKELDMKLMQGLNNSDHQKVEAGIRGASALTNHPYNLPRSTSSELAMEEFLQDAVPCKVRAKRGCATHPRSIAERVRRTRISERMRKLQELVPNSDKQTVNIADMLDEAVEYVKSLQKQVQELAENRAKCTCTHNPDCAYKT

SEQ ID NO: 2186 - protein, 217 aa, Pinus radiata
MGIDKNSVVPIQPLQFSREVYHMGSTQYDNMNFSANLNAPGAKTAVSTKKSVPMSEDKSCPIQDSLHHHRGNGEGISHSWSISACAAAEDQQVIDAKKQKRMLSNRESARRSRLRKQLRLNELNAQVAYLKAENGQIQNKLNIASQQYAQITEENYLLKIEAVKLSHEFQGLHYIITAQSGSAYKTMSIETGNCSAAHLSSESGIIPNSFTSPDFLF

SEQ ID NO: 2187 - protein, 465 aa, Pinus radiata; identical to SEQ ID NO: 1337

SEQ ID NO: 2188 - protein, 402 aa, Pinus radiata
MRSSASHSVDIQMQDSASSPVPKSLPSNTQLSTMSPHHFSTDVNRMPDIPPRNRGHRRAHSEIAVRLPDDISFDRELGVVGSDCPTLSDEADDDLFSMYIDMDKFTGFSTSSTQAMAATTQSGSEGGLTPPFQPTHHSRSVSMDGVFSGFQNNNGGSAPGGITSDKPRARHQHSQSMDGFPSIKPELLLSTAEASLAETKKAMSAAKLADLALIDPKRAKRIWANRQSAARSKERKMRYISELERKVQTLQTEATTLSAQLTMLQRDTTGLTNENSELKLRLQSMEQQVHLRDALNDALREEVQRLKLATGQGLTSGGHLMNYCNSSFTSSQPFFQTPLQSSHTYLAAQQLQQLHLQSQQSALNLRNGGTGSSQGHRDNLSEFSMTAEGLPVSTSQEAGCNF

SEQ ID NO: 2189 - protein, 475 aa, Pinus radiata
MEGLGDGYEAFVGRLKMDMATSNAPKTATGNSLSNPSQSQQLQQARYVGYPSSTNAFTVTREAKPALSDSSGNSVAMDVTMQEPVSSSGTVGVTEPSGNLGHSQNFSTDVNRMPDVPPRRGGHRRAQSEIAFRLPDDIMFDGDLGFAGFDMPTVSDDATEAEDLISMYMDMEKLTSFGEPLNSAAGEGSKLPSGAETNRPPHHSRSLSVDAVFSGFEGNMEDTKGNLGTMGPSRPRHRHSNSMDGSSSSQLNQLSSESLESKKAMAAKKLQELALIDPKRAKRILANRQSAVRSKERKMRYISELERRVQTLQTEATTLSAQLTLLQRDTTGLTTENNELKLRLQAMEQQAQLRDALNEALREKVQRLKIATGQLSSNNTNAFNMSATAQQLPLNRSFFPPTQHSHRLNQQFQPFQHSASPMNNQPLMGQSQVHQNFPQYGPAGQLQVLVGSQGGPAVESEVSSSSVNHPGSSAF

SEQ ID NO: 2190 - protein, 355 aa, Pinus radiata
MASQRDGDNSGGNRGQKTNLPQPVLKNPPFHTIGSNVVDSNCNSFKGWSDFPFPNNNSKHQFFPSVGYLAHFQPPWNDDLIKSPLESPTKKTSHRRSASDSLPFLEAPTDCFADGDELDCRQDVSLPLTESMDSENLEEIQPMSIFSDVEAFQKQKDQADGSTVTAPSISGSLVSLSDHNSFKDPLMLESKLNASSQFRSEPEDASICKGEQDDQPVKIEWSETTPPDLKVDKKRIKRIIANRQSAQRSRIRKLHYISELEESVTALEVEVSTLSPQVAFLDHRRAKLNIDNSILKERIAALVQEKIFKDEHSEALKTELQRLEQLYQQQQQMQCRQQRLEHAISSNAAFDFQQH

SEQ ID NO: 2191 - protein, 470 aa, Pinus radiata
MAHHGASDNSAANWGYTSSSSKLPQLPPKSPSFGIVGQDSSNNNIMYMGWPNFSFQGNSLKHQRTPSVGYLSSHGQPPWMDDLLDSPSENPAKKGPHHRRSASDSLAFLENPVASAPIEEIAEEDEFDCRSAASIPSKGSQDFDRLDEDQLMSMFADIEPFHKQQNQSNQPVSNNPHAALSTALDNRCSERQTISENPSTPSDHNSINETSMEEKVMTVSGQFKSEPEVQSVCKSEQPLQQPVKIEMPTSSSTMELDPNIDPKRVKRILANRQSAQRSRVRKLQYISELERSVNALQTEVSTLSPQVAYLDHQRVLLNVDNGSLKQRIAALAQDKLFKDAHCEALKKEVQRLRQLYQEQQQQNMQKEVAAPSTGSYDLQQQQFGKLEHNSSPQMMEQKTDHVSDSSSNLLKSGPGISDHRENNAANNHTSSGSQMLKGIMTSSCLMGDGNKCLEERMMGGMSSDYMVHNT

SEQ ID NO: 2192 - protein, 329 aa, Pinus radiata
MSDDAGSPIIKDFEGDLGCDDHDQLKDWLHWDFTDEGFILEDLIPCGEDDACDLGASAVHANAKGFCSDFGDFEDLFVNSSSSASPNNNSDAVDVNCHGPRTTEGTALVNGYSVDNKESQSSIHGLVPETRAHGVQDHKIVESKRQLRLINNREAAFQSRQRRKSYIQGLESKCKMWENYCNQLQGSIAFVCTENTVLRDELSRCKSQKGSNGVSEPAVLKDSPPLESRSHLTTLVVAGHIIGVHCLEWLLAALTILLLVGAVNPRSVNSTSQAEDEYKSSIFRVSSTFGEKRPVLEAFPVTSSKALSSCRHHYWRLKEFLFLSLFHLS

SEQ ID NO: 2193 - protein, 293 aa, Pinus radiata
MKMKVQCDVCEKAEATFLCCADEAALCSACDNNVHAANKLASKHQRVSLINPSSQSPKCDICQEKTGYFFCLEDRALLCRQCDVSIHSLNNLVAAHQRFLVTGVKVGLEPSNTISPSTKTSTQSSDITNKKPQTLRNGPTEVSASLHQGVQKGIGGGGISRRGTVSEYFSDLLPLWRMDEFLNLPELDNGYGFGEAGSSRADNANFVEEWPANSFSTEEDNSENCLAQVPEMASPPTASGLYWPRKIICQPKEGKRREDLTIFGFDDASLVPDIGCRSSPPDSPLSKRRRLHA

SEQ ID NO: 2194 - protein, 387 aa, Pinus radiata
MVLSSIQVCMDSDWPQSVMHERTLKPLEEMMPACSRPMMEQSGLKPPPPDQPLKCPRCDSANTKFCYYNNYSLSQPRHFCKTCKRYWTRGGTLRNVPVGGGCRKNKRAKRTIDHACAQMNEASTSVNELNINGSAPLGHSQLANSMFYGLPAGSATTHDGIHNLSLATRLADQRALYGNDSEFLRTFFDPRSCNLSPLNGLSSLNALNSFKPTFPGLNFNSNPNRTEALTRAVRDIDASFFESLPTQISEVPLPVLNSTNCDDLSPYSLSLQEGINNGNTNRYSEANQWRAIEQQKLAEGSDPVQVGLTPFSEMENSNNSRNDLNLKVVTSLPSCVKVEGQDNRLNITPEWPVPSEALFEAASDSAYWNGGVWPELTNYGSSVGSLI

SEQ ID NO: 2195 - protein, 309 aa, Pinus radiata
MQGHVEGGVGGHPEAQGGEPRHLQLQYIHEHGHSLHHSDDNGLGEEQDDGDGENDSMEGDIPSSGCNLGDSQKIVPVRSQATNQLTLSYQGEVYVFDSVPPEKVQSVLLLLGGREIPPGLSGMPIHGHHHQKVLADIPQRLNQPQRIASLTRFREKRKDRCFDKKIRYSVRKEVALRMQRNKGQFTSTKSNSEDLGSSAAKWDPSQGWHPDSNGNQQEVVCLHCGIGERSTPMMRRGPAGPRSLCNACGLMWANKGVLRDLSKNPSSLGSQNQPSSSHEQNDGRGGSHEVEVGDRNHSVTVPTNEHISS

SEQ ID NO: 2196 - protein, 167 aa, Pinus radiata
MRTLCDSCEAAAAQFFCAADEAALCAKCDEKVHGCNKLASRHVRLQLRESWSIPRCDICETAAAFLHCSIDGSSLCLQCDMDVHVGGKRTHVRYLLLGQRVELTNGSHIRDEHGNPKTMETARAWQKKYCQEHYRNGDPSHNNISNGNIHNVASCNKENVQSNGQKD

SEQ ID NO: 2197 - protein, 542 aa, Pinus radiata
MKDPGFKLFGKTIPMRDGEKNDGLSGSKLGHENTDNTTGTPARVAQVSDKDVGKEIGPELGREGPHNSNPEETRSVTVISDCGEDECKKSDEDLEREGGSTAIESDLKSENLEEKEAKASENEDKMLKKPDKLLPCPRCDSLDTKFCYYNNYNVNQPRHFCKNCQRYWTAGGTMRNVPVGAGRRKNKHSTSHYRHMMMAEGLATARADAPDGAAHHQVIPNAHSSSSRVLKGSQIQLLPLEVESAGGSILNFGQDFRLCESMSTGLNLADQTVVTRKAFKIKDDEKGPLMCGENRDDTSCESSTTTEKDVASKNFHTIPQMDQGSMVGWPSSVPPQQHYYGGAPWAYGWNFCWGGRSATGCPSGIAYAAESGNTSAGPWNNGTSGAGPPGMWAAGIPWPFVPGPYWASPTGWGAGTWNMPFSTVASPVTGGLSSCPPSSSAGSSGSPTLGKHSRDIPQSEDKPDGCLWVPKTVRIDDPDEAARSSIWTTLGIGNKPESITTGGIFKAFQPKTEEKDSVKASTQGLRSNPAAFSRSMAFQEST

SEQ ID NO: 2198 - protein, 191 aa, Pinus radiata
MSSCLTMEKHSLKECELCNKLQAKMVCESDKANLCWVCDVKVHSANFIVARHVRKLLCHFCQSPTEWQASGVRPSPTLSLCNKCFSAKHSARKHQFDENDHHVVTFTPSSASSRCGENDDDARGQHQRYGNGNSARKHQQDGNDNQVFPFTPSLEAAASASSGTGETLVMPMHNTGDFERAATSENCSEWH

SEQ ID NO: 2199 - protein, 507 aa, Pinus radiata
MKAKKGMVAKAIGGRTARPCDVCLRERARWYCAADEAYLCEKCDGAVHSANAVARRHERVRFAAGCAKVEAGFNDGLIFPGTRKRARSSRPHPHGAGPRSFKSKVGSVKDELVADPAAVPVPADSSAGDINLNLRADDDDYDEDDDDLLPQVPTFVPMAEELCGSRPRDVVECPVFEQYKYGVELKGDCGGADLGSCDLDQLLNSETDLSGFGVDMDMDVESIIGHGLDEGLGVLGFSTVNWDEKRVLQCRDVKINEGQDPEQQKDGDSGPTGLLNNRTIKAEEDKDRSDDLCSKPKDEGDHHVALKAKQEPDEPDQSWDTIELDLDQYHEDEEEELEDGTGFGDQYCMAQGASDDQGHDYQDIKIEFDPSSILIAGQAMYSETKLVSLSLNYEDVLTAWSDRGSPWASLHDCNSEGGGCQDAGLVPELGLSYNGAQLNIIGGGGGQEDSCRNAGGGREARVLRYREKRRTRLFSKKIRYEVRKLNAEKRPRMKGRFVKRTPGMFCD

SEQ ID NO: 2200 - protein, 123 aa, Pinus radiata
MKECELCNKLSARMLCESDQANLCWACDAKVHSANILVARHVRKLLCRVCQTPTEWQASGVSPSPTLSLCNKCFSAKQSARKHQRDGNDNQVVPLRPSSQAAPSASSGTGGNAGDADAQHRGA

SEQ ID NO: 2201 - protein, 475 aa, Pinus radiata
MGGAAAAAEDDDRLPVESPTLELAKKEELVCSGSSSKESLKRQREADLEVEANCKQYCNGKVIVDEENAGAGRKSDNRVELGSLPFYMLPPTKPSGRPGVYRILHQQDHEDGENQSSGNESSMGEEVAQQSLPRDLESGFDQGSGGDENGLSGSRGKALKLFGFEFRGSEGGSFEGTNGSDQPQDGTNILTAGEASTEPVEEELVIEAKNGDSGKLEDVGSPVEAGESGSTSNCLGSSAQENRKYECQYCCREFANSQALGGHQNAHKKERQQAKRAHLLATRSAAASANRSGATAWCGNINGNLYHRNFLFNNSYFTRMQVFQEDFPTFQTPQAVAAPSIPHYIFSYQQQQQAPVQSSLPGLMVSSQCGQFGLNEVRQVPIYGDNVNNYSFNPATALPQPPVPIPTSLHSSGLSRIRQASWSIPPPCRSGEWQSDHAAPVVMPVERKSSSDKFGLELDLQLRIGPNANPNSHFE

SEQ ID NO: 2202 - protein, 525 aa, Pinus radiata
MNDAYLNRWGSALFFGQMAEISPEPGTPCSSANSARLLHGSSSPSQSISQQSHYKSPLPPVLRGTNNKRARRPAGTPDPEAEVVSLSPKTLMESDKYVCEICEQGFQRDQNLQMHRRRHKVPWKLLKRETTDARIKRVFVCPEPTCLHHNPSHALGDLVGIKKHFRRKHSSNKQWTCEKCSKAYAVQSDYKAHIKTCGTRGHTCDCGRVFSRVESFIEHQDDCTTTKDKMVDDDYQLSMPCSFTGINSGNTVINATESTALFTATMWRGIENERLDPNWSSMEQRQELQLMPSKQQGTSETSEFPQPYSKPADEKSSPRLQLSIGLGSEITEKKLEENEIRINEEIEQQKQLAMRLACDEMAYADHVRRVAKRQLELADIELERAKKIREEAHAELDKARFLKEKATREISEAAITPLEITCRSCQRQFQWPLQYQSPSLNGFLSSINSNKGGADDENCHGNVFPEVSMMRYMQFSNPAVIEIDKGSQDKMQMSLSKPNGQLYGAHVSRTLSSSVTSSTKIEPCN

SEQ ID NO: 2203 - protein, 617 aa, Pinus radiata
MSSSPKLSSVVSKDQDHQHNMLHPHQEQQQTTAAAATNTGQNNTTVKRKRNLPGTPDPDAEIIALSPKTLMATNRFVCEVCNKGFQREQNLQLHRRGHNLPWKLRQRTTKEIRRRVYLCPEPTCVHHDPSRALGDLTGIKKHFCRKHGEKKWKCEKCAKRYAVQSDWKAHSKTCGTREYRCDCGTLFSRRDSFITHRAFCDALAEESARIPTGLVGGHLYNNSVLSLQGQTAGSPMSIMTAPSSSAFRPSQSFNHGGGGLNSSMFFTQSPKAIQGFLQDYDGNNSQGMGHEKPNLSGLMHLPAGASNNNPVNLTYPNLFTSTASHADLQPNAGAMDFTGNGAQSIFTNNNGNDHNAVGTQDQNHGGISLPNLYSQQHVGQSSSSTSQPQMSATALLQKAAQMGSTASNSSMLRGFNISNAIPPSGSSNHNNNNNNITMPFSGNNNLRSLENEGLVHDMILNSLAAQGSGTMQFGLNNMNQPTYAGGNYSVADHSEHLSSETERNTQTYGNHGSGPVQTKMQGSNQMLMLSGMGNHNVPRNEDGGIAGDGLTRDFLGVGGASSAGFPFRSHRAAAAPPHDNMTSRDSETNSGSYNNNSNNNKNNNNNHHHHQQWESLR

SEQ ID NO: 2204 - protein, 324 aa, Pinus radiata
MDPLVSHLPAEFPFPYDNSTTPTYPAQADSSSVFMHSLLSIRHLPYAHPISTHNIKPTPPQNEADDYEEEEEPILSLRPPGQTDQALKKSNTQPSYATDPDESDDNVTVALHIGPPTPVSLDCDTVSSVNDGCFQAKERLPMGQYWIPTPSQILVGPTQFSCAVCNKTFNRYNNMQMHMWGHGSQYRKGPDSLRGTKPSAIMRLPCYCCAPGCRNSIDHPRSKPLKDFRTLQTHYKRKHGIKPFACRKCSKAFAVRGDWRTHEKNCGKLWFCMCGSDFKHKRSLKDHIRAFGQGHAPHGVESCEDDDDPAPSEELDDGYSGTSQ

SEQ ID NO: 2205 - protein, 725 aa, Pinus radiata
MSNLTSASGEASVSSGTRGDVKPVQQLTVNAAANTSSQQTTIKRKRSLPGTPDPDAEVIALSPRTLMTTNRFVCEICNKGFQRDQNLQLHRRGHNLPWKLKQRNSKEIRKRVYICPEKSCVHHDPARALGDLTGVKKHFCRKHGEKKWKCDKCSKRYAVQSDWKAHSKTCGTREYRCDCGTLFSRRDSFITHRAFCDALAEESARVSAGITVGGVQLPGNNSLSAGALQAGASSMPVMRGVIGGGVGSASSFRPGGSGIPPLGAAQFPFSMRSSRMGGLPESGLSLVSNTNAGPSSRPRLSLWPENSDQMMGGAQQHNSHQQHIQPMNSMDVNPSAFFAQSPKPIQAMLGLSEYDDSQAGKGANLAGFLPMSSSNSGTLYSNLLTSGSLNVSNGINTDFGVTNWTDRSGSAASRRSLSTSAGLTTSSSSNTNNNINVDSLYSSNNSTNAQPQQHQQQTYISQMSATALLQKAAQMGATASNSPIFGVFGMAGSDMGLGLSWHDSAPGGQENQQRAAGMGEMVSGLDHNSHPFSISTSHGGHTGSHFVGNTRSPEHAGLQDLMNSLSGAPGSGYFTGGVLNNAQYGGNVGDSSNNFGRMINISANASDNNNQRMNSLSNDIGSFSQKSMGIQPGRNHQNLVLPAMGGLNPRTVEQEGGDGLTRDFLGVGHAAGGLGRTHLSQREFANISSLGSGIDLVPYTNQRDNSQSVGTADAGLSPNKSWDAS

SEQ ID NO: 2206 - protein, 526 aa, Pinus radiata
MPVDSARLLEIAGMDSTRAGLQGFKTVDPRFDPEGRQEEGFFVEDSNPIGSGEYHVGEGFSGQMQAFSDLQREEVAGNGGGQYFDWPLPASTLEGLLQGSSNNLSAWPAMAAILTSAAQAETSTNVLLANLSVLQQKAQQLEALVQEGRHDQPASEVISSILSELIVTAASVLFSVQNREIAKPASVDVQPVPDTAACVEIQAENRTPPVGVGFGKSPNPNGASDVGFEGGIDLQEEKFVVDIKTGVEEETNSPDDRRYEIIEINEDDILAEHTHFCEICGKGFRRDANVRMHMRAHGDEYKTNQALMSRPPEQGIKLPADSSSAPKARRYSCPFERCRRNQNHLNFMPLKSITSLRNHYKRSHCPKMYTCHKCNKQFSVVGDLKTHGKHCGHNPWRCSCGTTFTRKDKLFGHVALFQGHKPLLPDQELARPPAPKRLKATSNGGATTAQSAGDDDDGSIAEFLTGDLSGLADNKFQGYGTGDDDLFFAPKVSQMGHRQNEVPIESRFSESDFWADFSGEFSDACK

SEQ ID NO: 2207 - protein, 419 aa, Pinus radiata
MERRGQEVMSSNLGIPFENSRAMEALEQQHPYPNPQEHEEQAGQNKPKSTKSAGVKWIKEWVPQETVLNNGKCYFLKWVTEDTLKTLKEKQEEKELEPETLPPRVFLCSYEGCGKTFTDAGALRKHSHVHGEKQHVCHYEGCGRKFLDSSKLKRHFLIHTGEKHFTCPHEGCGKAFSLDFNLRAHMRTHSQENYHICPFEECGKRYAHEYKLKAHIKSTHEKNLANAVKLPPQTEREFSHPKAPTSLYGSVPSDRPFACPYEGCDKCYIHEYKLNLHLRREHAGYAIEENGRHGSDSEDEMDQGSDQDGNGRNTGIMTGSGRGRLRVNSKTSSATNLHRKFLNAAAVDLNTKTSSRAVVESKEPGKGHPREDSEETEEEEQEDTDNEGWGHGTETDDDDEDDNDDDDDADEEETEDDMD

SEQ ID NO: 2208 - protein, 651 aa, Pinus radiata
MMAGQVMEPPSTSTKSEGENDESKFSLLGQQFRRYGSTAQNQGQSSQPSSMSFSHPPMAHNQVPLNSHGQQSLVNSSHGGSDGINGGSISDVRHQHMPPLQGYNLAYGAHRTNQNIGESSGSSGNTSQACNPQVLLNTLSVLQRKIQQLQSLVQLMAQEDRQSGQSSAMMAQQQIVTTSVASIISQLMVAAAGMLPLSQEPGLNLSSMTTAGDLQLGHLLRDGLGLGLNAFQKNDAGNSAMGPVNGPGDANNIFSLEGGSGGSSTGATLATSHTVQPQNPLGTSNSTHGIGTSINVGSSDGKALRGVSEANDCDNGSDIANQAGDSLFTSQRSGGPGSGDDNDFSGNGRDEDDDGEGESLSPGCYDIVEMDAVEILAEHTHFCEICGKGFKRDANLRMHMRGHGDEYKTPAALARPDKAQDSAPAKPRRYSCPFVGCKRNKKHKKFQPLKTMLCVKNHYRRSHCPKMYTCNRCKNKKFSVVADLKTHEKHCGRDKWQCSCGTTFSRKDKLFGHIALFQGHRPVSSPNDMEGAAPQDQLVNDGGAPKIGNSVSGFANSCGNVSGILAGTEVVGSIHSNSNAPSIGPGANGTVLESSNDAVHSQIGLKNIGFSEDGNSHSVGVDSSNQMSGFPQAFTFQSLLSNNFLQQGRGN

SEQ ID NO: 2209 - protein, 531 aa, Pinus radiata
MMGHSLESPKPEGIENGIKNKNLSRSSSPSPSPNGMMEIVRSKTSRKKSRVTRSQINDFHANTNPVMGDDEDEDQGTANPGRRNRYHVCRHCNRAFSSGRALGGHIRIHGTSFKGVRAAVAAVATDSSNNSSSKSLFKGAEVDGSEDEDEDEEEDEEDSSASSHREQELSNGCSPKMVSLYTLRNNPKRSSILMDPEFTLELTGSGGAKRNCWQESNSGVFPYSESGSELKGLVAPQFGSWSVTRNRSSREPRKQRQRQRHGKEVAADDRDTANLLVMLAGRANGERESTEESVYDSKTLLVSNLESQGSIEDSGSEEEARILQKKKRKRRPRNGHEGGEVGKEDEFDVGKNIHRCNTCKKVFNSHQALGGHRASHRKVKGCFAAEGKGEGEGEGEGSLMMESDAAGNTAGMNDIWPPPKEEEGGGTVTMTMSHLTQEESPEQQQQQQSFSQKSGRPHQCSICQRVFLSGQALGGHKRCHWMGDRVTETATSVISKQESGGRVRNWRGEELLDLNQPPPVDEDGLRAAFDM

SEQ ID NO: 2210 - protein, 437 aa, Pinus radiata
MSCGYESNGDAAAFVQKDARGEMPGIRLNNAFVGSSSPRLEDVFCALQKYLPSNNEDEESLPAVDAYSCDEFRMYEFKVRRCMRGRSHDWTECPFAHPGEKARRRDPRRFHYSGTACPDFRKGTCRRGDACEFAHGVFECWLHPARYRTQPCKDGRSCKRRVCFFAHTPQQLRLLPGLSSPSSNSRSSTALHVASALKNYSLSASAAAYDGSPLRQALEGIVSSSTPGGSLISSPTSTLVGHSQSPPPLSPPLSPSASPPLSPEPGWSNTYRVGLQKAVLNRQIPGHRRHVERIASMPSEASRGLVSPRLMTLSDTTSQQQPMGELINSLQSLRMKESSVPSWLQVQPQMVNGGGGHVSPRISNLRHCVVQSLPCTPTHSETADDVGDWFEEPVQRVESGKDLRAKIYARLTRENLNQDSSPSIESPDVGWVNELVK

SEQ ID NO: 2211 - protein, 779 aa, Pinus radiata
MCGGPEHLKPASPHEGEDKVKMAENQSIKVKELSESCSSLHELAANNDLIGFKKAMEEEGSKIDEVNFWYGRQNGSNQMVLEQRTPLMVAALYGSVDALSYILSIYVTCGADVNQACGSDNSTALHCAAVGGSACAVETVKLLLHAGSDVNRLDAYGRRPADVIMVSPKLTEIKAKLEEMLNAAGSCQTSPAKLPNIVSGPPGFESKGMESMSPLPLLPLSLSLEASNNRSGCVNSPTSSPKSMEALKGFGDVNEKKEYPVDPSFPDIKNSIYTTDEFRMFSFKVRPCSRAYSHDWTECPFVHPGENARRRDPRRYHYSCVPCPDFRKGTCRRSDVCEYAHGVFECWLHPAQYRTRLCKDGTNCSRRVCFFAHTSEELRPLIVSTGSAVPSPRASSSLDMTSVMSPLAPGSPSSVSMMSPFLSNPQQGSVLTPPMSPSASSVNGYGGWPQPNVPTLHLPGSNVQTSRLRAELNARDMPVEDSPRISDYEGQQLLNDFSPLSTQARLNAAAAVISGGGNTTTRSGKYKSHGINTVAPTNLEDLFASEVTSPRVAVLEPSIFSQMSPQMQAHKTAQAYMQIQNQMLPPINTQAFSQGITQMQQAAIEPQSPGHSLMQSPFQSSSYGLGSPGRMSPRCVDVERHNTCGSPLSPAMAATINSRMAMAAFVQREKRSHSSRDLGANVNPSSWSDWGSPTGKVDWGVQGEELSKLRKSASFGPRSYEEPDLSWVQTLVKETTPEGKDGGNVSCSGETPHKGQIENVDHSVLGAWIEQMQLDQIVA

SEQ ID NO: 2212 - protein, 710 aa, Pinus radiata
MDLHDATPIVFSRIQSLEPENVSKIMGYLLLQDNGDQEIIRLACGSDALLQSWISKAKKDLGLVITTAPYNSHLPLHHISHVNNNSLARPAFASPALVSPNRPGAVYWGASSHLQAQQQERQLSFSLPTLSLQPHDQLRMEDHNNVYINYRPNSLQPLHISSNEKLQQATPAAISYEKLPNYSHEQLILRDDYQLRDQLSFFNDSLNPHTMFPAIDYLFPDQMVGYVNSNKLGIDHLNSITTVNSDNLSLTPSAIAPDVTESSPAPSWKPCMYFARGYCKHGSNCRFLHGYPRQDNTLPLSLSGSPTGSRNSDEAFQGGSLERLEVELQELLRGKRAPVSIASLPQLYYEKYGKTLQAEGYLTESQRHGKAGYSLTKLLARLKNTVTLIDRPHGQHALVLAEDAHKFMTYKSGVDDLGGVNSGSRQIYLTFPAESTFTEEDVSNYFRTYGPVHDVRIPYQQKRMFGFVTFTYPETVKIVLAKGNPHYVCGARVLVKPYREKGKLGDRKNPDRGEQYAKYAPFNHFDAKDYDHMHLGPRIMDNSDAIRRHMEEQDQVIELERKRLAELHFADAQRVHLAAAESHISFASTPLVVSHALENRFTNGFPQSEIESKASEDLNNFPSTDHFGYLLEVLENNEDEPKQDNDDQESYGHNLPESPFSNLNGSNIKTVLYTSEKTVGNMPTISKALAQASSTSVIDKELTCSICLGT

SEQ ID NO: 2213 - protein, 749 aa, Pinus radiata
MKEMAEYCSPALLELAANNDLSGFKQAVEEGGSSVNERGLWYGRQIGSGQKMVLEQRTPLMVAALYGSLDVLSYMLSGGRVDVNQSCGSDMSTALHCAAAGGSILAIETVGMLIKAGADVNFMNAGGRKPADVIMVSPKLAHFKNVLEDLLIMGSNSPMKIPCRVSGSGFYLPEGGGCFFDEHGCVVSVPTSSPLFSSPDATSPATVNSPLSSPPTSLDTPKNLCDCGQKKEFAVDSSLPDIKNSIYSTDEFRMYSFKVRPCSRAYSHDWTECPFVHPGENARRRDPRKYHYSCVPCPDFRKGACRRGDVCEYAHGVFECWLHPAQYRTRLCKDGTNCSRRVCFFAHTPEELRPLYPPACSSMLSQRTTMTSSDKMAVMHPLAPGSASSVLMMSSSNSSQSSFPNSPVSPLSSANTSSHSSFGGGSWAHPNLPTLHLSNGALQASRLRTAVNARDMHPDCSIESGDYEGQLLNEFAYLSTQARGNGPMATVSSSGNTPCRPRKFRAHNVAPTNLEDLFASEVFSPKMTASESAFLSEIQSHKSAQLSPQLQSQMLSSFNTQVYPQGSTQGQMHMQHGGVDCQSPSVFLSPPPVQLASYSLSSLGPLSSLTGELERQNSNGSPLSPIMSTAADSRAVAFSQRDKGSSRSGDLGGATTWSEWGSPTGKVNWGIRGEELQKFRKSASFGIRSSDEPDLSWVQKLFKEAPMESMDRGTMGRSMDIANSVQMEATDLGGWISQINPDQVAPLTL

SEQ ID NO: 2214 - protein, 779 aa, Pinus radiata; identical to SEQ ID NO: 2211

SEQ ID NO: 2215 - protein, 524 aa, Pinus radiata
MIDGMLFVQGQREGESPFSFTTTTHGGLQGSYTDGERTMHDNCPLSSSSSPRVPGDALEETVLQISIQTLDTLEEIGFYSGPYPERPGEQDCAYYMRTGLCGYGRHCHFNHPPNVKLDTQYMSELPERFGQPECKYFMKTGACKYGATCKYHHPHDRDGPRVQLNYLGLPMRQGEKECPYYTRTGSCKFGATCKFHHSEPTALLPDSGSPVYAAAELPLSPASGSSYPAGLTSWFLQGAPYVSDPHLQGSPTYMPVILSSQQSTPSVQPGWNTCHGPTSPLSSPEGKQQLGAGTVYSSSYMTDSSSSPEGKQQLGAGTVYSSSYMTDSSSSSHMHGALSSPVQGSSTAMEHPGVQCQVAAPQREAFPKRLDQPQCQHYMKTGCCKYGTTCRYHNPQERVALSPCCMLSSQGLPLRPGQPTCPFYSRYGICKFGPICKFDHPLTGPNCNPAAFSSSEQQTTSYPKGGSSGAHCQSTSEEFSKQDLKATDQYSKAEEASSLKQKSTEEGAGDRLAAKSPSTSGAAI

SEQ ID NO: 2216 - protein, 639 aa, Pinus radiata
MGSEVSNKPAFDPNWSFQPAVTSATQNFNEAMQMPLQARDSSNLSEAFSGPYPERPGVADCAFYNRTGSCAFGLNCHFNHPPNRKQVPQTCELPEKVGQLECQFYLKGTCKFGTLCKFKHCNDKAGSAGQAEFNFLGLPIRQGEKECPFYMRIGSCKYGVACKFNHPEPTEEGMASSVSSFPVDATTRSSSASSFEMPYSPAHLSRPSPRIPHAPGAHLQEHTVNMHAMNPSPPQGIPPMRGWNIDNHGSANTLSSSEGKLPIGVSFMNTQTEDLTGLQAVTKRDVFPERPGQPECQHYLRTGECKFGAACRYHHPKRTDHPSSCMPGQMGIPLPSGAVRSFPSSEEKRYYPGVDFRNTAVQCNNLAEINKQFFPPRTAPFSSETMPPPIMQTQASATQKQTFPERPGQFECPHFLRTGECRFGVMCQYNHPKEWFAKSSESMFNPTGPPVHYVPVAPMSSSEEKQHTAGIGLLNGTKQTTDLAVGSLPSVLTSAESICSAAKTIPTPQPWEFATKKETFPERPGQPDCAHYLKTGDCSFGAACRYNHPKEIIEQCMLSEMGLPLRPGKPTCVFYSRCGICKFGPRCKFDHPITGHTSNRSVPLNSELPVDPYSSCTSAADMQASSASSLSSQRCQRLT

SEQ ID NO: 2217 - protein, 226 aa, Pinus radiata
MAENYGSPDSSPRSENESGGGHMGGSDFSVKEQDRFLPIANVGRIMKKALPANGKVSKDAKETVQECVSEFISFITGEASDKCQREKRKTINGDDLLWAMTTLGFEDYVEPLKIYLHKYREMEGEKVSMAKQGDPTPSKEGNNAINGSSIENPNANAYSGLNPGGYNRVQSQSLPHMQQAAYGQPPGGMVYGHHGHIMGAYNMTAPNSSGGNSSGQQQQQAPRGQW

SEQ ID NO: 2218 - protein, 384 aa, Pinus radiata
MTVREFLQREEGSKLIMQGADCKEHRESEGQPNISSAVPAMPWWNGFGSQFPQSAWCAPVKPLFVDHPNRVPGPVKQVATQSQQLEQPSTQVAVQSQSEGEAMLAGTRRMPMSNQLGYSGANGEKQHQHQPTKSIIGSAPTEYLVPHAQLDFNHSIACAAYPYADPYFGGILAAYPAQAMIHPNMLGVQQARMPLPLDMTEEEPVYVNAKQYHGILRRRQLRAKAESENKLIKTRKPYLHESRHLHAMKRARGCGGRFLNTKKLEDSKANVDNGKTPEGHTAQAGSSSGSEVLQSENGNGNSTQELHGACGMSGSEVTSIAQSSENGTTYQYSHTNGAYLNHYQHPHFHISAFHPLSSGGEEGSSAKGGSIISGGSQQRVVVIQ

SEQ ID NO: 2219 - protein, 205 aa, Pinus radiata
MENTPTHTVSGIDGSAPDEQQPQADPVQQEAPPPGMIPPPAMTLLPPEFVMPHTQLELGQTMVRAAYPYPDPYFGGIVAAYGPQAVIHPHMLGVPHAGVPLPSDAIEEPVYVNAKQYNGILRRRQSRAKAESENKLIKNRKPYLHESRHLHALKRARGCGGRFLNAKKPDEVSQENNSNGSIVLVSSVDKPAAEKKNSSQQNTDS

SEQ ID NO: 2220 - protein, 293 aa, Pinus radiata
MMQNVTTKLGPESSQIDEQQKPPIQQQQVPSTGILSAHAESVMRQAQLELGPFHVNLKTGNAFWQAQAAYPYPEPFYGSYVATYGAQAMIPPHMFGVQQAGLPLPPSDMVEEPPVYVNAKQYRGILRRRQSRAKAESENKLIKCRKPYLHESRHRHALRRARGCGGRFLNTKNDGSNEKDVSGDNDSHDSTGQSNKVLNPDSGKDGTSHDLNGIQHIGNLAPIGNGISAHSGTVSPGQVGVGESVSNGSHYTYNQRRGFHSSAFHPLSVSTTESGQVGGVVSSGGHHTAVATQ

SEQ ID NO: 2221 - protein, 571 aa, Pinus radiata
MFPQQGGGRAGGGVVSPPGGGVKQEQQGDLPSRKSVRQLDFTSTSMYGDSSTSSDTALRTSQQPSSIKQGSPRGSFSGPLTDSKEGTPKKSRQCNCKNSRCLKLYCECFASGIYCDGCNCVNCYNNVDHETVRREAVDAILERNPNAFRPKIASSPTPVRDNREDMGEQLLPAKHNKGCHCKKSGCLKKYCECFQGNILCSENCKCIDCKNYENSEERKALYQSDITGSLNYPQPVSNASVSGTTAPVGYSSPSPSKKRKTQEVLFHQTPKEHASRQTSQALQGSTMKNISSTVNASNPPLSTVNGTGALGIPSSKVIYRSLLADVVQTDTVKGLCQLLVIASREAANACGAQTSLENGPLDKQAAKGNSLTNNKDSPESSTQNEFRSEQIRDDRLETDRGYKVAAGASSTNCAEEAEFDSGANFSKQRAMSPGTLALMCDEQDTLFTAPSSPSGGCKKPCSHHTTQTFAEQERIILSEFRDCLRSIIDVGKRRATQYSTEAAMTMKRNQQPDLNPQLSRPVPVSKTVTVPLSVPPSASSGALVTEVNASSSGSLRNGDKSDAVVTFQQKL

SEQ ID NO: 2222 - protein, 441 aa, Pinus radiata
MLPRGSIRRATGPRSGIRSRRTAANSVVSDSPYNNNNLRKDISIEFHEASIHKYAEGFGITQNGANANGMNVDGNKSTLQQGEGEYPSNAIAGRCSGTSASAPGQSISVESGSGGSLSRGSEAAIATPSRNNQMARVQHLDIHQEDLDSPETAGTRKRKRVPRVNGGEKGGRGLRQFSMKVSQKVESKGRTTYNEVADELVAEYANLDSTLVSPDRQQYDEKNIRRRVYDALNVLMAMEIISKEKKEIHWKGLPKTSINDVEQLKAEKLLLKSRIEKKASYFHELEEQIIGLQNLVKRNEHRYSSGNTPSGGVSLPFILVQTHPRATVEIEISEDMQLVHFDFNSTPFGLHDDAYVLKEMNFCKRPFSTGADSGHEDCCNGTALAECKSPESNVCQNLIPSHSPLPSVGASYPMSSTPGRTYSTPPVPGILKARVKHENMT

SEQ ID NO: 2223 - protein, 452 aa, Pinus radiata
MLPRGPSRRGSSTTGPRSGVRSRKVTLTQSHVANNPNNNRSYSSISNSNGVQNDPIHEAGTHGYAEGLGIVQNGAIATPIGMEIVEYNPDAAKEEGEYPSTTSNGMVGGYSGNLTSLPGQSVSMDSGSNCSPSRGSDVVMATPGPSSAIARLHHLDGQGEDFESPDTVGTRKKKRGPRAIGGEKGGRGLRQFSMKVCQKVESKGRTTYNEVADELVAEYANPNSALISPDQQQYDEKNIRRRVYDALNVLMAMDIISKDKKEIQWKGLPSTSPNDLEDLKAKRMGLRGRIEKKMGYLQELEDQIIGLQNLVKRNERLYGSGNTPSGGVALPFILVQTRPQATVEIEISEDMQLVHFDFNSTPFELHDDAYVLKAMGFCEKPFTDGMDVTGHDSFANGTGFGENNMTITNMYRHSLPSHLRTTGGSFSMPSATGKNCTSPPVPGILKARVKHE

SEQ ID NO: 2224 - protein, 380 aa, Pinus radiata
MESNELPSGQGYVEADTGAGNTTLSGTGGRRYNRSKLAKRAKIGPQTPGSNIGSPLGNAPTPISSCRYDSSLGLLTKKFISLVKQADDGILDLNKAADTLEVQKRRIYDITNVLEGIGLIEKRLKNRICWKGLSVSRPGEVEDEATVLQAEVDSLNLEECKLDDCIRDMQERLRILSEDDRNRRWLYVTDEDIKKLPCFQNDTLIAIKAPHGTTLEVPDPDEAVEYPQRRYQILLRSTMGPIDVYLVSQFEENIEEMNPVDLATELVPSGICPAEGVTISSVQEGATFVEMECQGHETRQPCTELTSPQDSAGGIMRIVPSDANIDADYWLLSDSGVGITDMWRTETNSTWDEVIELNPTDFGIGEGSPCPQTPPSSSVF

SEQ ID NO: 2225 - protein, 645 aa, Pinus radiata
MGIYDEIGYPGNLDLLSVPLEGDSMCENEGEVMHDDGLSEDDIDVDELEKQMWKDRIRLRRIKEQRKGKYHSDTAKQRQSQEQARRKKMSRAQDGILKYMLKMMEVCKAQGFVYGIIPEKGKPVSGASDNLRAWWKEKVRFDRNGPAAITKYQAEHATPGANESNMVVAPTPHTLQELQDTTLGSLLSALMQHCDPPQRRYPLEKGISPPWWPTTHEDWWPQLGLPKGQGPPPYKKPHDLKKAWKVGVLTAVIKHMSPDIAKIRKLVRQSKCLQDKMTAKESATWLAVVNQEEALARQKNPNACPPTNASVTTHAGSLTFSSGSEYDVEGFEDDPNSIYTNNDVQDCKPQDLDLLNSEVQECKPQDFDHFNVGISNEGVSALQVGDNVDFIRKRKLSQESPLEDQKVYTCPHEQCPYHERQLGFSDQSLRNAHQSTCAYRTDLQGMGYQRPEPQESKSLFCISTGQPKQLQVQGKVSIFPSEKEGQTTSNGNVNLNPLGTTSSAIPTGNQQPISELLALYDGLHQNKTATLGNLKMMNGHNQLEVNMHPASQGGEVFKITPDDNFFGQGVIAGNNGNDFGSNMQLVMREGLNLDQSRVYDQPFIHHCQEMNGDMKFVSAYNNIPIDYAVPETVSKYDNSIWYFGA

SEQ ID NO: 2226 - protein, 662 aa, Pinus radiata
MERPEEFGFSGNLDFLPFITEAGGGGGGGRDSMGENVGDALREEYVSDDEVDVDELEKRMWKDRIRLRRLKEQRKGSDVVDDAKQRQSQEQARRKKMSRAQDGILKYMLKMMEVCKAQGFVYGIIPEKGKPVSGASDNLRAWWKEKVRFDRNGPAAISKYQVEHSAPGKDEFNTIIVSTPHTLHELQDTTLGSLLSALMQHCDPPQRRYPLEKGVPPPWWPTGNEDWWQQGGLPKGQILPYKKPHDLKKAWKVGVLTAVIKHMSPDIAKIRKLVRQSKCLQDKMTAKESATWLSVVNQEEALARQQNPNTCLLTSAEGFGHAITLTSSSSSEYDVEGVDDVPDSACPKHDGQGDEAQDFDLFNMADAKDTLWSIGNGEDASMTRKRKLPEELLMQDQKIYTCPYEQCQHHERKNGFLDLNSRNAHQSNCPYRTDVQGMEFQRLECETNASTFYTSVAQPDHPHLQEKGVSESKSGGQLASLGNQTIHPLNTGSFIMPPKTQQHINELLALYDSSVQQNKASTNGTTQFVSGNNPLEIITEPGFPKEDFSRITPEDVFYGQVVVLGNNNSECSISMHQSSGSMHHSSGSLHQSGGSMQQSIREGIFCDESKVFDQPFQPQSREMIRNLGFGLPCDVSFGSVESFHRGSNNRSTNGDKIWYFGA

SEQ ID NO: 2227 - protein, 156 aa, Pinus radiata
MFSFRMDVIRLRQRLIQLTNSLFQEGFLDEQFTQLQQLQDDSNPHFVTEVVVLFFEDSEKLLHNLTNALDKEVIDYKKMDAHVHQFKGSSSSVGAQRVKNLCIALRTFCNDNNRAGCIQCLQQLKDEYYLFKDKLQDLFHLEQQILSAGGTLPMME

SEQ ID NO: 2228 - protein, 549 aa, Pinus radiata
MGSSAELTLNCGPSVTSASNVFKSFSVVGDHLEKMRRHEEYIKGLEEERSKIEAFKRELPFCMQLLNDAIDACKEQLAECERTSPHEDVQNAPNTSGRPVLEEFIPIKKSSQATENKPEENHVSKKARFNNSDKPNWMISANLWNPDPESIDSRKGGGISMEESLKKQDSQHQEHSLPSNAKLFSDSKHRVRGAFQPFSKESHVIAPRPVRSTVERTLPNLALSSAEREVDSSLVANETVSLNATTTTNNRISRSKETKEVHTPVHEKETVSVIDGANTSPTTPNTSPAQTQRKSRRCWSPELHRRFINALHQLGGSQVATPKQIRELMKVDGLTNDEVKSHLQKFRLHTRRPSPSPPTSNPQAPQLVVVGGIWVPPEYAAHAAAAAQQGQGGLYNPIPTTVSCPPLSHYCQPSISQGHEYYCQINPAASKSQLHHSVSLYCDQQQEQRQQTPSQSQNSPQGPFQCNGQSSGARGTSADAGREESVGKDAESDSSSWKAEDYVETTEVMNMGRGLSLRKQPHKFLNEDDGDAADNRARDQTGKQALVGR

SEQ ID NO: 2229 - protein, 529 aa, Pinus radiata
MPIANFTPIGLNVLVGDDDPLCLLALERMLRQCNYNVTTCSRVPQAISMVKENRDRFDLIMSEVYLPDEDGFRLLEIVGLGLDLPVIVMSTNGDTSVVMKGITHGACDYFVKPIRIEELRNIWQHVVRRRGRESLKDDLGECEDREVSDSPDTSSKKRKDTSSGDYSDEVIDDISSLKRARVHWTVQLHQQFVIAVNQLGIEKAVPKKIVEIMKVQGLSRENVASHLQKYRLYLKRLSGAISEPHPVASFQAADDSISGGMMKLQQGEKGVASSSGAKGLNLGTGVSSSLGVRGLDPSTLKSLQQYRAYQQKLVANRAQIFGGIGVRPPKYSDTAKVPESMGGSKSGLQRMSSVDMGLLWKAQRDQTADENKKQGIANLQNLPQKRSNSSEQRRFRGSHPKHSRTRTMTDLPMIFQSAKPEVTFQKTPPAKSMLQDVDELQPMEDISWLDNTFKPESPRAAVISFDSFVQDFEGSSLSAATIEESNRHAFASTDFEGQRKAGVENEEFFSSGSTDISDYLVDDLMPHPR

SEQ ID NO: 2230 - protein, 565 aa, Pinus radiata
MGKGSISNSDAGSSVLDRSCVRILLCDKDPTNSQQLLELLRKCSYQVTAVSTAREVVSVLNTEGREIDLILAEVDLPKSKGFKMLKYITRSTCLQRIPIVMMSAQDEVAVVMKCLKLGAADYLVKPLRINELLNLWMHMWRRRRMLGLADKNIISKNLGHDLDMLVSDLSDSNTNSTNLFSDDTNDKKVRSHAGPEISTQVTPSECELQSHDSPKLELSLKRSSEGSPEEPEPGSLAGKFLSYPKRSELKFGGASAFLTYVNASVQANRTPNQISVGENKASQQETAIPEKHGVMGPPSTDNRPIGLSHSSEAVKSSNRTEFIPCEEHCRDRLETRSCNVSMSPEIPIGQVAPAGEQFPMVQGGLPNEGSGMNNHDISSLPAPHFLPGMMNHSMSASMQFCHGVHHDVGPRGAPRLIPFHTFQPCHGMPVNATMPYYPYGFVVAPATIGSSHAWPGMANLSVSEPKITQVERREAALNKFRQKRKDRCFDKKIRYVSRKRLAEQRPRIRGQFVRQTNDMEAAGANGVVYGVDSSEYEDDGYVHGSGELRLTSSPESLAGDTENAI

SEQ ID NO: 2231 - protein, 436 aa, Pinus radiata
MMSSQKGESLWHKDPAIEPHHAIQAISTTIAFQTSNTSKSEGPTFPKDNSSFQRLVPQSVSSNSPEPVDSNQENPFPRSSLPSSSKKLNSSPMSSNIIPASSNVIDPEHISSTSSTFCTDLHFSPSISQHHPPGILPFLPHPSESSLRASVMPPSQSAFSQSLFSGDYMKQSYGDTHSGDPLQDIFNFPDVASECSQRNQVAASSGIVGQDHTKPDEWQDWPEQLPSDDDSLVASWTNLLVVDSGEEPGLNTIYPAATLPSTGSVSQLQQDLCAPAGGNQVASSSTSSGTGTSNKPRLRWTPELHERFIEAVKKLHGAEKATPKGVLKLMNVEGLTIYHVKSHLQKYRIAKYMPDQREGKTSCSAAGKEDNKRNSSDDLSTLDLKAGMQITEALRLQMEMQKKLHEQLEVQRALQLKIEEHGKYLQKMFEEQQKNR

SEQ ID NO: 2232 - protein, 371 aa, Pinus radiata
MYQQQHANKKNNMSMQVSSGDAALVLTTDPKPRLRWTVELHDRFVDAVNQLGGPDKATPKTIMKVMGVKGLTLYHLKSHLQKFRLGKQPHKELNDHKDGERGSRFSEGHGASTSSSRMMGQEMNEGFHISEALRMQMEVQRRLHEHLEVQRHLQIRIEAQGKYMQSILENACQTLACQTGPSAGTETRRQELPDLASKVSNDFFRTPPRSTVNYPSLTEMNAFRGEHNHIRQQTQLTDCSVDSCLTSNETFGKMIEENVQGVSKKRPMSFYCDNDTSIWEKDGKGDDVRVHELSNELSNACLGQKETFKGEQRPSSSSVKIESERNSASDVFETRGSQLQEPASSSKTDKDLRNSPKLERPAPKKNPNCCR

SEQ ID NO: 2233 - protein, 678 aa, Pinus radiata
MVSVAEWKDFPKGLRVLVLDEDSEAAAEIKSRLEGFEYVVSTFSNETEALAVLANETNSFHVALVEVSTGNSCGGFRFLQTACNIPTVMMSNRSCLSTTMKCIALGASEFLQKPISEDKLKNIWQHVVHKAFSESGTVLSKSLKPVKATIVSMLQLGHEHDNVKSKSSQNGDSSVGNKAEADALHKVQSCMPTRTDSIKQESSIEPCNSEKFPAPSTPQLEQGGRSPCEEDKTLRLDDTTNLMVGPAHPDTNCGDETIREVRLDAEATSTWSSQVDSPASVKKESQDMSRISLKARISTQSGVKPADLTRDQLGNGITSRGTCLHSGQETADVHVVSASGITEEEVGSAEGSKSDDENIETEAILSSYVCIEENVDSSTENIKEKRNSAEHGCKKSNISSSKKKFKVEWTMDLHRRFVQAVEQLGVDQAIPSRILDLMKVDGLTRHNVASHLQKYRSHRRHILPRDDELASRRYWQHFDPAWTRTKQDESWSRTGNPASGPILAYSPVQLHSTPHGTPVGPPLHVWGHPTIDQSGSHMWQQLQVGTPTTWQAQDGSFWKHPGVYADAWGCPTVGMPFYPQPMMKLPSNHGHRSTPKPNSTMQGVSVQYPATLDPLNESLLWEKSINEHPPKEVIDEAFKEALNNPWTPLPLGLKPPSMESVMAELQRQGINKIPPPAS

SEQ ID NO: 2234 - protein, 587 aa, Pinus radiata
MSTISYNSHAPSFQFYQNPSSDWLLHNKAMDIQSHHQHQQFLFWEPTPLLPANHKLNPFTAFPPTSLESIELSKSDADYTSLWDSGQIDQKQHISALILRASERDYLENKVDFCDNVSVSTVTDEKYVLDGLYQGFDEEGGIVPSKAFGELPFPFFDDGIDVISFLGNNQNPCSPSDHSEAVGSIGSCSSASLNSIDKFGNEFVLRDEYPSEFEAVLGLQVPLLGQQDLLQILVKCAEALSEGHHGLVRSMVSKLQEFSSPLGDPLQRISFYVSEVLKNHSFSVVNQEENDEESSLEYDLAYQAFYQLLPYHKFLHFTSNQAIQEAVDNASNIHIIDLEIRQGLQWPSFIQSLAHRPGGPPKLLKITAIGQDEKRLKQTGRRLLEFAESMEIAFAFHPVVVDLENLDESALNIEAHETIAVNCSVVLHRLLCKSGKIHGLLALLRKLNPAVLTVMEIECNQSMPSTVGRFLQCLIFHRAVFNSIEAIVEKNNPDRVLIERVYVAPNISNVLVHDKENSGMYACIDSWRKFLRHSGFKDSPLSNYSKCQANLLLGMYPNDSFKLHQDGVSITLAWQDTPIVSVSVWTC

SEQ ID NO: 2235 - protein, 694 aa, Pinus radiata
MSILRPLESSGSSSSEGCLNVGRNNRVGTPPLINPSNVMKLHCRPELNGVTSNPRAQLGPFTSEIHSQLLSKRSLSDFEMQALFRTVRQRNHSTPILPLSSADSVVLSHSSASLSQSVSSYPYHRHQLNISPYSQGYICNPASLSTVSDSNVDKLLSLPALQNASALEKPASNQNFANNRTFILPKLKSPDAHRVAIDNAKMDDYQEGIRHKLQELERELLSDNDDAFIVSALSPEQSSHLDREWVDTIQNLLSEEAVLLSTISGESQGYHNSNKENPTSQASRSQPEDQKHSFSSQPEPKTSATQPRIDAASSSRKLLVECATAISEGDKDSALSIIKKLMQVISVYGDPMQRLTAYMVEGLVARLGPSAQSLYNTLKWKETPIKSDILSATRLLYKVCPYIEFGCVAAISTILEALKEEENVHIIDFEIGEGSQYVTLIYKLAARVGGPPKLRITAVDDPEPISRSVGDLYMLQEKLKEIAVQVGVHLEFHIIPQKAADVQPYMLGCRPGEALAVNFAFQLHHMPDESVSTRNPRDQLLRMVKGLSPKVVTVVEREMNTNTAPFLPRFMEALNYYSAVFESLDVSLERENRDRFNIEKQCLARDIVNIVACEDAERIERYEVAGKWRARMTMAGFTVYPINTSVDNSIRPLFESRGNNYRLKAEKGALHLGWLDKVLVVVSAWHLESHSMIK

SEQ ID NO: 2236 - protein, 840 aa, Pinus radiata
MNGMLSRTSGNSLPPAQLKHQILQSKTSPDQAQKRHCKSSVWQRSRSGGEIEPTSVLDIRSPSPTSTLSSSLGGSSESAGAVAAVSSGLLCEAVSDGGGGGSGSGSGGAETLLLESSGKEAFNNGGGSTGSPARWYSNRGGSGNGGREGFGWRLNNGEQQPGGGGMVEGKSEVKKEDPQQHSRAEEWGSGGGAGTAGGMDDLESMLFESGAAPPDQSLMRWLLGEIEDPKDLPPPQIKSATSGGSTSAPQFVDPSIEPNFADPGAFAFSNNNLSDVIAPPQHASVPSSFRPSYATLPNLPQQQFIPPPPPPPPPPPPPFAYNGPMPTPFGPNAYHPEVLFSGPAVYGSNPVQHLGPDFPRFNMAADPNRNNNNLLFDMPHPPPPKRFGLEHQLWQQTFKQQEYMSMMKPQQQQELLQSLHRRQQFLHQAPPPSPHHQLRQKAVVNHTFKVGGSGAVADEVHVIVEQLLKAAEAVELGNLDHAQAILARLNQHLSPLGKPLQRAAFYFKEALASRILNTTATNTGGDNRNATVTGTATSNISSPLDMVHKISAYKSFSEASPLAQFAHFTANQAFLEALEGAEAIHIIDFEIGLGGQWASFLQELAVKLGGAPPVRITALGSSASSSLELHLTRDNLCNFAKQLNVPFEFELLHFDHIESLTLREREAVAVNLSLLPSTFSSPDSISRLLRLVKNLAPRAVVVVDAETTATAAAASAATTSSASFVHHFLEALQFYSFLFDSLDAVNINMEAVHKIEKFLLAPKIDATISSAAAPPWKTLFAAAGFSPVAFSNFTETQAEYLIQRLHSRGFEVEKAHAALLLGWQGRPLVSATAWRCGPPP

SEQ ID NO: 2237 - protein, 573 aa, Pinus radiata
MGEPCLMGNEYPLQGIKAEEAVLQQTHFNEATDSQLSEFFCGNSDIGPYSFFGDNAGHTISPFALNPTSTALFPPSNALITPNIHGPNPPPLSFTPDFKTFKVPLDEKHPELQLPYGPNPSYPEKNVVFPMPAAPRGHVGVAHEGFPEFEKSLYWQQIQQREFQPAWKTMINRSVRDPLFSAVKQEWPGRTHQGRVDLDEVQKSAILQQLLNATNYVELGSLDIVQAILARLNQYVSPRGKALQRATYYFKEALGGLRSLQQTNSKSYLSPLQLVHKINACKNFSEISPIPYFANFTANQVLLEALEAVDKIHIIDFDMGLGGQWASFLQEIALRPGGPPALRLTAVGYESMEMHLIRENLCTFAENLNIPFTFQVVEIPQNEDLNRSMLNLKEGETIAVNYSLGMQGLLSKDSIASILHLINRLRPKIVVVVDHENEQAGSSFAQKFMEALQFYALLFESLEAVHMNMETIEMIEKFVMAPRICNVVEAAYRRHREGENLPNWRSMFQASGFTPMMMSNFTHKQAESLSRSRQQRFGFCFEAVKKQQEQILLLGWQRQILVSVSAWIVNNVV

SEQ ID NO: 2238 - protein, 663 aa, Pinus radiata
MNVQFETEPTATTQSSQYVLDHPHKAFGTCLPDPGPSVASNISLEQSSGSHEWIHGTPKTSYQNFPCSPQEVISYGLGHCTQAHECYTSDKYRMSDGSVQSSPLHDNDSLQSQRSTHEALPYSTGHSFYSSPSVQSCSSNGSPASPQVSQNYPSGRHYLHSPQEPYGPAGSGYSGTEQEEDLKYMLQELETALLVSESDDPDIGSICEEQGFPEYSEWNIENMHDTTDNYCQSSLSVYPKPEQVEVSSMTLNHVKVEIVNEVDMGTICSSTINSSEEQKQELEFDIPYGDVKELLIACAKAVADSDNDSIKIGKLIAEIRQVVSISGDPMQRLGAYMVEGLVARLASSGAIIYKTLRCKEPSSPELLSYMQVLFEVCPYFKFGYMAANGAIAEAFKDEDRVHIIDFQIAQGSQWVTLIQALAARPRGPPHVSITGIDDPVSNYARGGGLELVGKRLSKLAEICNVPFEFHPVPVMGPDVQVNMLKYQAGDALAVNFSFQLHHMPDESVNTSNHRDRIIRMAKGLAPKVLTLVEQESNTNTAPFFSRFMETLSYYTAIFESLDVTLTRESKERISVEQHCLARDIVNIIACEGAERVERHELMGKWKSRFTMAGFKPYPLSSIVNSTIKSLLEGYCENYTLLERDDTLYLGWLNRPLIAAAAFQ

SEQ ID NO: 2239 - protein, 541 aa, Pinus radiata
MATCVEKMSDENKPTRKGGRKAAVKPKTVPVIENTVASPAGKKPKEDQKFPSSSPDILMEDEAQKENRVVSTPKPVGRSRKKSALQNVSNLIPPPVTNSLQEELEAVRIRLQKLNMEKEKTDKLLEERDALLREKEAELQLKAKAQEKLQLELKKLQKLKGFNPVMSHPLGQSLRMSELAKEEEKKKKKKDPNRPKKPSPAYILWCQEQWNQVKSENPNVVFKDMGAILGAKWKALSAEEKKPYEEKYEAEKEAYLQVVGQEKRETEALKLLHDEQKQKTALELLEQYLQYQKDAEGNEKSKRKEKDPSKPKHPVTAFFAFTNERRAALLAENHNVLQIAKILGEEWKNMTKEERAPYEQIAAEAKEKYMGEMELYKQQKAEEAASASKEEEELRKLEREQGLQLLRKKEKTETLKKTMKIKLNQKKQLKEKNSDPNRPKKPPTSFLLFSKETRKKLVQERPGINNTTINALISLKWKELDTAEKQKWADEAAVAMMQYKKEVEEYNKSHLKEQQQQTQQHISFDRDEMKVDGTLPAPITN

SEQ ID NO: 2240 - protein, 317 aa, Pinus radiata
MEEAKNKQRGLERLKTLASDDMTGLALGVGLSMAMPEIARHGDDQKSAPLQLEPLTFRPIATAARAETAPAPSAPFLWFMSKNCREEVTVAESNLSGIVRGGGIDMNRVPATNESEYSSVFQADALRTIDTGSVVVKRERERTFELEAERDRTCDVSSRTSDEEEIGSTRKKLRLSKEQSALLEESFLEHSTLNPKQKNALAKELNLQPRQVEVWFQNRRARTKLKQTEVDCEVLKRCCENLTEENRRLQKELQELRALKAVPPQCVIGQDNYYMPLPATTLTMCPSCERVATMENSRNLSFSKSRISQFAQKSAAC

SEQ ID NO: 2241 - protein, 372 aa, Pinus radiata
MSEVFDLGSMEDKGFVEQKRRLKTPSQVEALENIYAEHKYPTESMKAKLSRELGLSEKQVQRWFRHRRLKDKKGKKEEPDSNEELDAGSGSNLQQQQHLVRTEMGRSEKKRLLGISDYPSAVLAAELNDHDMLKRNQRVMEEDPHHAGTVSTSQDTSSLQSKSSYEMDALRNGNYVEMKGSNSKKSKGQVMHMGMEHTYPPQHFAVATEDQYIAKGLKQAGGSNSKQAKNWNRFKAKDSENHRFVNNHDYPSAVLAAELTDRELLKGNHDIVEDPYVSLSQERSSLQSGSSYEMEARRLPSKSLNSFEIEARSKRREKEGLHMVVEPIYWQQAVEHQAISAVKAQLGRLFREDGPILGVEFDPLPPDAFGYR

SEQ ID NO: 2242 - protein, 884 aa, Pinus radiata
MQLRNTPTMTSEMHSFIPSGIELLAFSSKNPFLDNSEAEASSRSSVMGTSYQGLGNPGANLGNWKSFNVPQNRSNTGWTAPSIVVPNNIQQHHGGLSSYSGQILPNPIVVARGGSMQASSSGDIRKSDMDVASQNPHHQSDGTHLFLMNPKYPNEYPEGTSTAAANMTENRPTSGLAPPGFEAQKNILEFAHFPTQIPTIISEASPSLREPSHGAGSDLPGSENMQHSQLMLAQFNNTVNWANRYIGSQSWNREPFIDQNKVDESFRSHEYGSKGQDGSGQRLSLSLSSHQPSEIHLPDMGNQTNVLQFGGDAKSKLGDFFNSAHGTDGLAYNISSYPRNGIPGKGTMDSIQGGGRSAVLQYLKDGSTGALSSYGISLKNSRYLKAAQQILYEFCNVGRGVETRTSPKQKSAMGVNAIPGSSGTRSHEFGAKTETGMMNQPLYSGDRFELQRRKAKLVSMLDEVDRRYRNYCDQMHLVVSSFESVSTVGAAAPYTALALKAMSRHFRCLKDAITGQLQVTIKALGEKGSVVPGTSRGETPRLGFLERSIRQQRAFHHLGLMEQHPWRPQRGLPERSVSVLRAWLFEHFLHPYPTDADKHILAKQTGLTRSQVSNWFINARVRLWKPMVEEMYMEELKEEKVDQVTHNSEAERSAGTNNDEKTMFTSGEPGNKCTANSEEAAFKLDHSSSTTSQTAQAEISSGNVTLHLQSKDPEMAVARETNSEPLNSSMNTSHVGDIKVDEAPGYNIFDQDKGFRNELYAGKYQTADHSGMAVDFSSYNNSTASTSVAAYSHGDLNPRHFPSSGVSLTLGLRHSGGLSYNPLSEQKYDNNIYFSRVHDDADPNNQYSMLDNEVSPGNGFMQEQDLQYRNYIVNGSRLLHDFVG

SEQ ID NO: 2243 - protein, 792 aa, Pinus radiata
MSFGGFLDSGSSGKLISASDHNMASGAIAQSRLVSPGVMPLGRPTKNIYTSPGLSLALTSGIEGQGEVGASVGECEQGKSKDEEYESRSGSDNMDGGSGDDQDAADNPPRKKRYHRHTPQQIQELEALFKECPHPDEKQRLDISKRLNLETRQVKFWFQNRRTQMKTQLERHENSILRQENEKLRSENLSIRDAMRNPICTNCGGPAVLGEMSFEEQQLRIENARLKEELDRLCALAGKFFGRPIPSMPSVPLMPKSSLDLGVGGMPTSLPSASADLMHGPAGGRTGNIIGIERSMLAELALASMEELFKMAQADESLWIPNLDAGKETLSYEEYMRQFPSTITPKPIGLATEATRETGMVITNSLNLVETLMDVDHWKEMFPCMISRAATVDVISSGMGGTMNGALQLMYAELQVFSPLVPAREVYFLRFCKQHAEGVWAVVDVSVDGLRDNSPAGFMKCRRLPSGCLIQDMPNGYSKVTWVEHAEYDDRGVHRLYRSLLNSGMAFGAQRWLATLQRQCECLAILMATANVSARDPTAIPTPNGRRSMLRLAQRMTDNFCAGVSASTVHTWNKLSGNIDDDVRVMTRKSVDDPGEPPGVVLSAATSVWLPVSPQRLFDFLRDERLRSEWDILSNGGPMQEMAHIPKGQDPGNCVSLLRASAMNSNQSSSMLILQETCTDASGSLVVYAPVDIPAMHVVMSGGDPAYVALLPSGFAILPDGPECRPLALNPTGNGVGVNSPRVGGSLLTVAFQILVNSLPTAKLTVESVETVNNLISCTVQKIKAALHCEDA

SEQ ID NO: 2244 - protein, 759 aa, Pinus radiata
MGRNRAQKATNGHKMNTEKVENSNQQSNLVNGDASLTSQTMRQSNNKISGSSSHHVAPAKMNSRKSEIQESVSNAKENEPTVNPVTGDNHVESDKPELDQKTGRCATKAGKSTSMVGKKYILRSLSSSVRVLRSRENKSPKDLPKIEGHSTEISAEQSQRRRKKHKKKTHVVQDELSRTRKHIKYLLLRIGFQQNMIDAYSNEGWKGQSQEKIRPEKELQKAASKILQCKLAIREAFHRLDSLCLEGSLPESDFDSEGQINSEDIFCAKCGSKELVLDNDIVLCDGACDRGFHQKCLEPPLETANIPPEGEGWLCPECDCKVDCFDLVNDHFGTNFEIGDSWEKVFAEAVVSADGDENPFDLEGMPSDDSEDDDYDPESPEKPDSNQQEKGSSSEEDDSTSDAENSNKSSSDDEGSESDDSSDVSSEDSQEHFPEYLADSGKRKSKMTRGKKCLESSELPVISDLDESGNITSSVSGRRHRQDIDYKKLHDEMFGLTASDQDSMSEDDEEWGPRKRPRKGKQFDVEQNVSTVSKLTQLNKESVMKKKGKGPNVDSSEDFKQSKFNLCREYDAETENEEHKISKKAEHGEGGPVEDVAASGFKASLKENQQEQLGSAPVSAKQKVFSRLPTPAIEKFRVVFGENNFPPRSLKEGLAKEFDISFKQVDKWFDNARHFSRHQDRSKQVDNSDGSNESSIIKDDNITSERVKVPGSAGKGIKDTNIVLSAERGKRKGGKKHGIKDLKGPTSTGDKAKRQRRRN

SEQ ID NO: 2245 - protein, 296 aa, Pinus radiata
MELGDHDGDMGGMALPMLYGGSAPNMIHDSSKLKPGENGTAGTGTPTPSDETRPSDHELLQHEHHLHHQQPPGAHVKKSVRYRECLKNHAASIGGHAIDGCGDFMPSGEDGSLEALKCAACNCHRNFHRREVEGEPPCYFCYSPRGRKRPGAGPPMALLGLPPAQQQHPLNAAPLALPPTSAHVVPRSMLQGAGGDNDQDGSSGMSYMNAYGTGGMMPIVMKKRFRTKFSNEQKEKMCAFAEKVGWRIQKQDDAAVHQFCMDIGVKRHVLKVWMHNNKSHMLAAKAQRSEEQCTSQ

SEQ ID NO: 2246 - protein, 851 aa, Pinus radiata
MPKAGKGSSGSLRKKQALSNTASELRPKAAIQKTNNAGSISGRMRERKPRLHVQMIASILTKKRTGEASESRNDSELEDKQYLSNSSKTNANFVAGKLVKKTLKKAPRLNLIKNDSQKKPSKSSASRSYAAQKPERPQQRKIRRTKWKGDSKNITKVKTVRTSNIDGLKRKQQRRKKKKKAQNVPQDEVSRAKRRIKYLLLKMKLEQNLIDAYSGEGWKGQSREKIKPEKELQRAEKQILQCKLGIREAVHQLDLLSSEGSIADAVIDPEGRVFHEHIFCAKCKMTDALPDNDIILCDGACNRGFHQKCLDPPLATENIPPGDQGWLCKVCECKLESLEAINAHLGTQFTVDNSWEGIFADAARIANGESTATGNGEEWPSDDSEDDDYDPEKQEIRDETGYENNMSDSGKSSGWSESYNETDNESDASLTDNLNEYISKGKKRSRDTDEKNGQEAIIDLDTDENDGSDMPVSGRRQRRDVDYKKLHDEMFGKDGPCEDEVSEDEDWGPNRRRRRAKQPDTNTTKDSSNEEKEHVRKEADEKVAEHSQSSIKDKKHIVRLPANAVEKLRKVFAENELPSRSYKENLSQQLGLTFRKVHMWFKNARYMSLKSRKEMPRNENCNETNLMGEGDMGPKKKIPKEKKAESTCLLSSVRAEYKSRNTKRKHRRKNIKAPLSISSRSERKRTMCRLPANAVERFRQVFAENELPSMSCKMALSKQLDLPYRQVHMWFKNARYMSLKKKKMNRLKESAPVISSHTRRLEVESSKPNPQIKEPDDAGNSYLTEMEKLGNIELKLENMRKILETVCPKRGTDFSNDKNQEGIANLLSEELLVYVPVVELREKSLQVAPVR

SEQ ID NO: 2247 - protein, 1002 aa, Pinus radiata
MSQQSPASMDQLPLQTHVAQQIRRDKLRIQGFQHPSSPKSHISSGHSKQAIPAYEECSAGYLQGYPGHIDQDNIKNVFPGHNIHMISSNNYNLPAASDSRVLPPQNTGHFHTQSPQRNPLVGTIHSGQSLTPNFDGQVNASKSGSWGSGGPQFGMMNNNAFLNLPSLTVNSNAMTADLFAASSIQTSSFGSNGREGSMATYFPGSSIQADTMQTLYLRNRGIVGYTDSLASGNMVLVNNTTGSSLATHNFSGNGQQQQHFVGITVPTASPSQHSSVGAIENSSTEQQSANSSLLTSRLEAHAYDSWQAGGNELTFLQTTDAASSNQSLCGQLNNSVSLGSLPVAERSQVRMRPPSMSSIEEEQSGILPSGLRLQLDPPTTATGQRQGLSLCLFPKHASTVQLPPFQNHSTELDINCPGIAQTASEDNSFRIDRDARDGMMGGGFSNSLQSPGVSKQIHSSYRGVTGFPNVLRGSKFLKAAQELLDEVVNLSKFGKSEPAKHHKSQTLFGTAADKWNTAKETSIKNGITDTSAGFLNSAEETNISHNTEISMAERRELQIKKAKLVAMLDEVDQKYKQYYQQMQIVVSSFETVTGFGTAKTYTSLALGTISRHFRCLRDAIVGQICASSKSLGEEDMAGNGKGETSRLRFVDQQLRQQRAFQQLGMIQQPAWRPQRGLPERAVSVLRAWLFEHFLHPYPKDADKHMLARQAGLTRSQVSNWFINARVRLWKPMVEEIYMEEIKEAELGHSSAEKDYKKSGDSKADTKSEEGSENSQNSEDQKHTKTTQLETDAEDVVCEQQNISVSSGLKSEHSPDMRYGRSQAFSIEGVSNDDVSHDVRDEGVTPGKFKKARSGIEGSTYQFSPNMSSIVGFKMEGSCQNDKFNDERHSSENYILVHSGMALADSGGSGCLNRYDGQEAFTPKFSGSGGVSLTLGLQHSDGLSLSGTQQRCNSSEGRNHGLGNVSHDYCNISGTAAAHAANAYESINLEKRKRFATHLLQTL

SEQ ID NO: 2248 - protein, 355 aa, Pinus radiata
MANTAEQKNKETTVLAVEGHRSIPAPFLIKTYQLVDDSSTDDIISWNKEGNTFIVWRPAEFARDLLPNYFKHNNFSSFVRQLNTYGFRKIVPDRWEFANDCFRKGEKQLLCEIHRRKSVQQSSAAPASRCVSPVNSVEEQALSSTSSPVSSHAEAALVNCGQNSTSGLHGENEKLRKDNLLLMSELAQMKKQCNDLLLFLSKCVNITPDNLSNILIAASQTNCRDENLKALPLDASTLAKLANKSVFSENHEKKRPPNLLTELCRSNVKDSDTAVKSTGGREANSDGHENDNKTATPMLFGVPLISGKKRPIPEAPASSSCVSKGPPLKGIKTDMPHEETPWLKVCSSRGGKVYN

SEQ ID NO: 2249 - protein, 223 aa, Pinus radiata
MVSDGAVRDAGRLVPAPFLVKMYRLVDDPSTNHIVSWGENNNSFVVWRPKEFSASVLPCYFNHANFSSFVRQLNNYGFRKTFRGQCEFSNKLFEKGKQYLLCHIHRRRASNSSPMPMEYGKSSLLFPIILPTQHSNVLAAPLPSSLSGLAEKETFRKNDSSLLSEIPRLHNICSRDIKFLGRNPSLIDTDRSKIDNVSPGSSMADVTEEMRMIPQKLFGVLLC

SEQ ID NO: 2250 - protein, 550 aa, Pinus radiata
MTIKVSGKIRRVDGREISYPEFRDKYMKANEPVLLTGLMDDWRACRDWVSPDGQPNLSFFSLNFAKSRVQVADCDRKEFTDQKRLGMTVAEYIEYWHNLNSRFYDTDCDGNRNYSSVLYLKDWHFVKEYPDYNAYTTPTFFLDDWLNLYLDSYRIHGIEGVDEDCECDVSCSDYRFVYMGPKGTWTPLHADVFRSYSWSANVCGKKVWHFLSPSQSHLLYDRYMKQTVYDIYGDVSATQFPGFSETYWLECIQERNEIIFVPSGWFHQVKNVEDTISINHNWFNACNISWVWNLLVKDYNETQEYIEDIRSIADDFESLCQRNLAANTGMNFDDFFVFISRMALANFTQLIDIMHSWERRYSRNGMEASQIEKFQQILFNLVSIRNVGQNMASIHYFDGYSKEYKFYIKDVARLFVEMGMSKDINNHDLDDALEKKCHVSQITNLKIPNFDIVDEADIKTSVSVLEGSEKPICDKNSSKVQIRFCNNLSSSMPQNERTEAVCGNLLVDGFLTKDCQVTVTNPKHLFQIIDDVIASVKEKALCLGYDLIQT

SEQ ID NO: 2251 - protein, 824 aa, Pinus radiata
MEPLHNGCLDVPNDLMEIPAHAEDDFSKAFRKVDTSGQVEFSLSDLEAGRSKRKNVKKMKKRADQELQESSLPEDIADEEKPMNSSSERFSLMCHQCQRNDKGRVVWCSKCSKRYCVCCTERWYPFQTEEEIAEACPFCRGNCNCKACLRRGSRLKVRTKQTSKADMVHYYQHTICMLLPMLIKFQEEQIKEQVVEARIRGKSAENMEIPKAKIASDERLYCDNCNTSIVDFHRSCPDCSYDLCISCCRELREGCQPGGDSAESSQQQYTKRVYAQSENKKQKKIARGSTGWERRLQSVNSHTAHPLKPLPDWKVNSDGSIPCPPKERGGCGDNLLELTSMFESNWVAELEEKAQKIASSCELPETLRDSQPCSLCFKPNSQDKIELSDKSRRASNRKDSSDNYMYCPTVQDIKCENLQHFQKHWIRGEPVIVRNVLDDTSGLSWEPMVMWRAFRETTKGKFREETKTVNAIDCLDWYTVEINIHQFFKGYTEGRMHKDHWPEMLKLKDWPPSNYFEERLPRHGAEFISALPFQEYAHPKCGLLNLATKLPANCLKPDLGPKTYIAYGTREELGRGDSVTKLHCDMSDASCIKVALDFVSPENVPECIRLTDEFRLLPKEHRAKEDKLEVKKIILHAMNSAVTQFNSLTKVKKETKKGKKEPELIPAGLENMDSSLIITGKEKSNTADPEEIELTSDVPNNVELSPSVPESGKLISDVSEKIELIPPVPEKEKSTLTMPEKIELTSSVTENWESNPTISENGEPSLAVQENRESIPALPENGKSIPALPENAMLITAIPENHESTVSKPVKVGPPVSVTLETIC

SEQ ID NO: 2252 - protein, 191 aa, Pinus radiata
MAFAGTQQKCKACEKTVYVVDQLTADGSVFHKACFRCHHCNGTLKLSNYSSFEGVLYCKPHFDQLFKRTGSLDKSFEGTPKAVKNEKLNDGEIKTPNRVSALFSGTQEKCLACGNTVYPIEKVSVEGVGYHKACFKCMHGGCVISPSNYIAIEGRLYCKHHHAQLFKEKGNYSQLIKTPSVKEVSENSVHE

SEQ ID NO: 2253 - protein, 187 aa, Pinus radiata
MEIKRIQNPSRRQVTFSKRKNGLLKKAFELSVLCDAEVALIIFSETGKICEFASHDDMATILEKYRIYTETHGNMESSSVQSVKIGESQLKALREKMNKLKKKERNMVGEDLDSLTMKEMQRLENQLQIGIKRISDKKMKILVQSSKSLLQKTFQPPDDFFTPNLLHCLLCCIHIHSTGTRVGRGEN

SEQ ID NO: 2254 - skipped

SEQ ID NO: 2255 - protein, 460 aa, Pinus radiata
MEIKRIQNPSRRQVTFSKRKNGLLKKAFELSVLCDAEVALIIFSETGKICEFASHDDMATILEKYRIYTETDGNMESSSVQSVKYYSRTGLRTCLVIQSQDPTAEYLLGQKIGTTPTPIGNGNLQAVRLESTKMLLEPLHRLKKADARLNLSQGVLDEVVGEELGVLPGMDSVFAVGALERLIQFIGGTTSYTKELDRKFDMIIYDGISCEETLRMVGAAERSRWYMRYLRKLAEKTDTGRVTAPSLLKLVEASLKPDSTVDSGWRTAAEIWDIADNMLEKGSRAFADPLKFSCYLVMDPSNCMSVNAALRYWGCAIQAGAHVSGAFYPASPSYSSINMSIDDTFFPLVTASVPFLSMDSTINWDIALKDMNADAKKLLTMNNGSGRNISSVTFDQTKKTVTLFLPGFDKSEIKLSQWRGGSELLVESGDQRRVITLPSKMLGKVAGAKFENRNLVVTLK

SEQ ID NO: 2256 - protein, 151 aa, Pinus radiata
MVRGKTQMRRIENATSRQVTFSKRRNGLLKKAYELSVLCDAEVALIVFSPRGKVHEFASPSMQMVLDKYQKYSQESGISNRTKEKNTQERMLTEQNVFLRKMCAGSQDDSDLTTPAIHLESIRMEHSEVETQLVMRPPHVQKNHLSTYSVH

SEQ ID NO: 2257 - protein, 481 aa, Pinus radiata
MGRTPRCDQMGLKKGPWTPEEDQILISYINKHGHGNWRALPKQAGLMRCGKSCRLRWTNYLRPDIKRGNFSLKEEQTIIHLHQILGNRWSAIASHLPGRTDNEIKNVWNTHLKKRLLQIGVDPVTHAPRGYNVSNCYTAVNIRDHHGEQADHQLQSHVCVSEPVKKTFQKEGNSIESLARQPLQEAKAPQDHGASSNSPVIHKTPDDQNMMSSDQHEAYYSLNSSGNNYTYSSDSSRVLSTKPMELVSESPFGACSATNKEQNNSGKVAAVMPYDYSKTSEKKMLAVDYTSLLQSSYTDSLKFILDDDGEDSNSSEYHVNWKPLAGNQQNFVSLGSGEFREDDKPVVQQADPEVSVGYDSSMLNSNVEFWRHELSLWPTTESNTMGEPAVAYSSSNGAAPPVIGQQKKVKVEPSGTNFSVEQFLELADHTMGTNMECKSNIYDRWPDMNLADQDQGMEYWVNLLRQVGPLPFLETIAPPDL

SEQ ID NO: 2258 - protein, 308 aa, Pinus radiata; identical to SEQ ID NO: 1545

SEQ ID NO: 2259 - protein, 358 aa, Pinus radiata; identical to SEQ ID NO: 1557

SEQ ID NO: 2260 - protein, 583 aa, Pinus radiata
MAAVVLGSEAASASASASASASASASASASASASAVKEQAIEEVGTLKKGPRTSAEDAILVEYVRKHGEGNWNAVQKHSGLSRCGKSCRLRWANHLRPNLKKGAFTAEEERIILELHAKLGNKWARMAAHLPGRTDNEIKNYWNTRIKRRQRAGLPLYPPDVQLQNSNQKAPQTPSEPNNIDLPYESRPSNNPLIFSSKVENGTPSYDGLKHANTNPMPFSGLGNVSMGPLFYQANPIQRVKRVRDTSFIMGPPSSPFGRMGVNGHMGMNDVSKSLQPGFKARVPYPLQAARSDSFVAQGCFPYDPNLSSTSNLPLGGFSSGSHAVMNGTFSSSRLFSGQKLELPSSQFAESVQTAGSSINPVLNRSTPLLLPPVPTQTINQVDYSFSTPKNSGLLESMFQEAQTMGGVKAHSSSNSSIDLQGGSKSSISNPLNNGFPMQIKIKHGDNSDPTTPLDGHTFSMFSESTPPLGTSPWDDSSSAQSPIGKAMKSEEPNEGYISSGSCGDENVSSMLDLTADVLPDTDWNAQISGIEKDQSLLNDALNTMFSDDLGMGVQQMPSETSPSNQTWGLGSCPWSNMPGVC

SEQ ID NO: 2261 - protein, 308 aa, Pinus radiata
MCPKTVYYAMTRNSPDPPTSSTPASSRWSREQDMAFEDALAVHDEQCQDRWEKIAALVPGKDAAEIKLHYEILVEDIECIEAGLIPLPSYVSSGEGSADQAVEIQGTKNRSHSANFQSGDVNPTRKGGSKADQERRKGIAWTEEEHRLFLLGLDKFGKGDWRSISRNCVISRTPTQVASHAQKYYNRLNSANKDRRRSSIHDITSVNDGDTSTPQGPVTGQENSSAGAAGKPPKSLSQPSLPRVVAYGPPVGQPIAGPASSAVGTPIMIPPGHVPYVSSGPFPGSVVPGTPMNLVPVSYAISQPTIHQ

SEQ ID NO: 2262 - protein, 305 aa, Pinus radiata
MDYYDEDPRPRFQLQASSIPAPQQSASIDRKHAAFCIATGILIFSYGCLLPGIWQILLTWIGLSLAIGPFAPISLTGGDIRVGCGEIIEEPQLETPKLEPERKNYRGKAKRSENSNPEIPILNIPRSDEIPEGNKNGEAGAKVSVVSRVSDDGEWTAEDVELLKKQLAKNPPGKPGRYEAIAEAFRGARSVDSIVKKAKSLGERKLGDDDSFAKFLAQRKISDKIEMNLAEGKDLADDEEDKGKKFGWSSAEDIALLNALKVFPKDTNMRWEKVAAAVPGKSKTQCMKRFSELKLNFRNSKASDT

SEQ ID NO: 2263 - protein, 1007 aa, Pinus radiata
MASFPAVAVPQEERTETVAGRQGIENNGVHYSEQSKSQSIRFPSDEVSSSGDEFTTKVRKPYTITKQRERWTEEEHHKFLEALKMHGRAWRRIEEHIGTKTAVQIRSHAQKFFSKLEREASAGGVPMGKAQDISIPPPRPKRKPSHPYPRKAGTASQIGPSTNEEENRSLSAVSSAPDRLCAGSNLGGETQKNAAFAPYNARLRPLQTHDNINLQETNMESSSTSISPSSLKLFGQTVLVPTNESGLDVNVKGAFQEFKSHKMERQLLDGQIPESSKLEKTKGSLHSVGVEAKMKVVKSENASGVTSNIPASESGTSMLEGSGESNANLPCREIHTAQQDSDEPLSELDNNMNSLSREHQASVPVSIYSRHIPVQNVEGEAEECVAINTLNGNGSLSDTTGKMKAYVQTSQLNVFTPFPGMPGSFNPAYNNLERFGCIPGFVAPGTAPNGSFPPWHLTPSAALHHPAYAAATLAAAAFWPGLVSGASPVATGDPQPPREGKNGHSFGEDTSAMAAVTAATVAAASAWWTLHGAIPPPFLHPGIYGPVVAAMAAEAAAVAAAAAASGSSSPLCKTGPVREARKHEKMITTEEDGEILDAMPASPSANTKGKLSMEQLDDGIPGLSCPKSGHADGLPEVLPSSSDPNITSCNEESCDVEMQIEKPNFQVEEQDDNAFCINLPEGETTNSRKVIKERSSSGSNTPSSADPEVDPCLGMNTEVKGNSERDFEFNWVGSGSSDAGGEEALASKRTNCILPETLGKTEREKNNLSTKQDGKVDYNGNYVNKDRYQSYGGDAAGHRSKSGGHLNETWREVSQEGRIAFEALFNQDVLPQSFSHCQNLRDQDKVPKVSRKSFCNDAKQKPSKTSRDEIQDDAQNMVVNQKQACSGVHAEDCSCAHKIALKPAGSPTQVKKIQDSEATDNNWSLEKYGESERSLLQNKSVAVDFKPSKSSVISSSGNFRSGRGFVPYQRCSIEAKKNRLHTRPTQNCQDDEREEKRVRLKQEVEDG

SEQ ID NO: 2264 - protein, 281 aa, Pinus radiata
MGRSPGCGSPSKHEEHLKRGGWTAREDKILIEYIKTHGTGQWRGLPRKAGLERSGKSCRLRWLNYLRPDIKRGNISPEEDELLVRLHRLLGNRWTLIAGRLPGRTDNEVKNYWNTQLSKRVQRGEFEPKFQKPFKERAIPSPSSYGKVVVGTDNYTSQILPLKTRAVRPSARAITDGDNLHSYDYDHVPDTNYGINQEGCLKALDDHAMEIDTSKSWCQLLLEDCLGDSQYNQMEEVNALQPISMTNTSNGTDDQHQHQPHSPSLYQSIILQENDCSSGCD

SEQ ID NO: 2265 - skipped

SEQ ID NO: 2266 - protein, 311 aa, Pinus radiata; identical to SEQ ID NO: 1546

SEQ ID NO: 2267 - protein, 410 aa, Pinus radiata
MAVGNTKAPGSESSGCGERGQRIKGPWSPEEDAALQKLVEKLGPRNWSLISKGIPGRSGKSCRLRWCNQLSPQVQHRPFSPEEDRMIMEAHSMHGNKWATIARLLPGRTDNAIKNHWNSTLRRKCLAEKDSSGGGPPSTSAPVPTFTMGGEKRSSADLLSNDDGGSAQEDQDQDQDQDQDQEGNMEVESQRFKRRLNYSPESPANSHTNTNTTNSPPVSTAQQQIHRPLPLQSAFKSYSNNLDPPTLLSLSLPGSGMKEEDSKTDDRNQNSAPKNQLQQNVELNGFAGTQTQTQQLQYTFIPPYFQQPVMTPTSTNGYLKTDDAMVMMSEAVKMAVGQAVSLVFQASQSQCGSLGAVERSGFSASGGLLDIMREMIAKEVKNYMAMSQPNQCNQTGGLNCAMDSSLPRKV

SEQ ID NO: 2268 - protein, 308 aa, Pinus radiata
MVGIMLVGSTMIPAGGAAAVAVTSVEEGGELKKIRKPYTITKSRESWTEQEHDKFLEALQLFDRDWKKIEAFVGSKSVIQIRSHAQKYFLKVQKTGNGEHVPPPRPKRKSARPYPQKASKLGILASAQNSTSGLPSSTMPGEYGFSLVSQSGDAFTSQDTSSQPVSSWIHHGVPRGTDTSGLIVADVGNTNVNGRNGNSSDDSSTNEWSLQSTPDQINQEFCLKGTPDFSEIYKFIGSTFDPGVTGHLKKLKEMAPIDRETIMLLMRNLSINLSSPDFEENKLVSSPCDMNVGGQRPAVTTIVDGQVV

SEQ ID NO: 2269 - protein, 355 aa, Pinus radiata
MASMKGKSPGHDEPDRIKGPWSPEEDAALQHFVQKYGPRNWSLISKAIPGRSGKSCRLRWCNQLSPQVEHRPFTPEEDATIVRAHAQHGNKWATIARMLSGRTDNAIKNHWNSTLRRRCQGGGALVIDDEISSGADGFRKRNLSEDADASRKFKKLSLGTTTTTTTTEPSTSSASDRSDSSLVFGSPHVYKPVPRPAPLALTSEPNLNLNHHEASCSSTDPPTSLCLSLPGTDAPARPSVVPIALPLPVTSSPVAPPGYIKAEEAMEWMNSAINTTLTQVLTPFLAPARSHGIMPETLGSSGLLAVMQEMVAKEVRDYMSSMQHRNNNNTEFRGCVASPPPPPMGLRVSNSNALG

SEQ ID NO: 2270 - protein, 490 aa, Pinus radiata
MSFTPGPEKGSPVSSKPEIQKMKKGLWSPEEDKKLVQYMMNNSLIGCSWSYVAKQVGLQRCGKSCRLRWINYLRPGLKHAAISLQEEQLIIYLHSILGNRWSQIASHLPGRTDNEIKNYWNSYIKKKLNFKQHSLPCSSSSEAASNSRETNIPSQFDHTYNTNSVSANAYDAYMGPHSAKPSEVLPEGYLRAHDDIFSAMITAENQHSCVQDVVDLKHEQNNEFEIAADPTNNQLISCSRLWTDPTSTHTSNSISQAFTFPGLQAQEYSYKSANSSRCDKLVEPWNTLQSHEMHCSVNNSLGCSITVPSGVEISNSLKEKSESDGHIINENENEIMIHNSSLSASSVITPWSVGHSYSNAADCSIVCPGDYTSNKAEDYVSQLHESYLPHNSRPQFSAPEILWTDVDQHFNIQPQDENEGEGHAYLRYGEQNLGVPTHIKIDRLKRYQFPEIGGVQQDCSSMGNEEGLAALTPTMFRGRKTCRFESEGEA

SEQ ID NO: 2271 - protein, 1003 aa, Pinus radiata
MTGVKVKREGKTNRAQSSHLYLGNDDGLQKLEPVTCSALEETTSDEVKREEKAENKSQSSSLSVGADHALQKLPPVHGRTGGPTRRSSKGGWTPEEDETLRRAVQCFKGKNWKKIAEFFTGRTDVQCLHRWQKVLNPELVKGPWTKVEDERIVELVRKYGCKKWSAIAKHLPGRIGKQCRERWHNHLNPAINKDAWSLEEELSLIRAHQIYGNKWAELAKFLPGRTDNAIKNHWNSSIKKKLDSYLASGLVKQFPGLTVPKPTIGSASSTGGSFNEVQGGADLEEISECSQESTSSHCHLSGSFMGPSSSSVQVGLERSELRKETCKMNSDDELEVHHEPLWSLNSKTDGFLLLQDGPAGYSNSPIPEAVPPVSSCELNELTESVITGNSCSVGSPKEVSNAVNVSMSGASGGLESFGFEHGGSTSAAKDMVSSSAFYTCLLLDSTDMVGMSHNLCAPVFVDSLHPISPGSSDMMLNSLVRVGDGICSTEMPSSVLNGGICDGAGCVQVASEFQHSDEMLQYCKPVIHDLKVDCQDGRSGPDMLNLTFDEKAVNLKVEASNVQAESPISECLFYEPPRLPSLEFPFINCDLINSCSHLQQAYSPLGVRQMIMSSVNCSTPYSIWGSHDKSPESFLKSAAKSFRNTPSILRKRRRESSTPVQGGQHDKKEASSVDHDSFLSHGSLDEKENSLKDTSSADFQNSFAEDGVSLPSSKKRIIVSPPYCLKAKSTVPGKSKEKQLLHAFEGTNYTEVKNGCSVDIGVVGNHQSDIGRSGKDEIHKASIQSSFENVQTGGILLEQNMNSPLFCTNGNNSYQICGMSYSPLTPKTLFGRRSETPAKRTDHKGTMKSTTVIVQSTYIDSPNLCEKKRESKSIFLVSSCQTPAMSASKTIDRAIGEDWLNNVPDLDNLSINCCPFSVDKSLGSPFEWKSPWSLDWTSPLEKHGRDLLLEDMSILTNSADGRDDAVGLMKHLSEHAASAYAQAEEILSNDEKKLSQTVSSVQA

SEQ ID NO: 2272 - protein, 461 aa, Pinus radiata
MSRAHCCEEMGLKKGPWTPEEDRILISYIKRNGHGKWLALPKQAGLSRCGKSCRLRWTNYLRPNIKRGNFSLKEEQTIIQLHQILGNRWSTIASHLPGRTDNEIKNVWNTRLKKRLLQTGVDLANHVPRKCNISCFDGAVSVCDSHEKDTDHQFKSHGCTSESAKKVFKKEGNNSEPLARQPLQETKALQDQGVIQKTPDDQNMIDSHQHEAPYYNLNSSGNNYSYSSRSSRVLPMKPMKIVSASPFGLCSAMDYKGKTTSEKLPAPVMPFDNIKTSEKKMLATVDYTSLLQSSNSDFLKLTLDNGDVNSWNPLAGNQQNFVSLGFEEFQENDRTVVQQAYQEGNLAYNSSTLSLWPAAENNLLGEQAVAYSFSNAAAANVSGQQKTVKVEPSGTNFSVEPFLELADHDSMGMDMESKSNIFDRWPEMNLVDQDDGMDYWVNFMRQVGPLPFVQIISPPDL

SEQ ID NO: 2273 - protein, 454 aa, Pinus radiata
MGHHSCCNQQKVKRGLWSPEEDEKLINFINNNGYGCWSEVPEKAGLQRCGKSCRLRWINYLRPNIRRGKFTPEEEKLIISLHSVVGNRWAHIASHLPGRTDNEIKNYWNSWIKKKLARSRLDSKLHAEQSTSKRPELSQILSKQLNIIEEERILYTHYSNDQSPQPQLFVAGNSLTVSNQKQEDSKMSQALGHTDISNDHAASSAGMMEKALYSIYQKNGKSNLESFVHEHKVQGSDSDSELAALAYDSVYIAPCSQPPMEYNSDNLGIAGNRINQYADQQRGLQGPKNGILTGYNAGELSHIASTSLASEMPATSFPFQNICKSDDMPLLPAIFSDYCSLSIQAGSDQHAQTCNYLPQLLEHGEDWGANYSMKYSSNGVSGSVDEIQIPILSNHKNQFPELNMDEQEPYLNSSLQWYEVPHSFFHPEHLNNHDGMESMEPISPPHGYVDRQLL

SEQ ID NO: 2274 - protein, 499 aa, Pinus radiata; identical to SEQ ID NO: 1589

SEQ ID NO: 2275 - protein, 520 aa, Pinus radiata; identical to SEQ ID NO: 1591

SEQ ID NO: 2276 - protein, 490 aa, Pinus radiata
MAPISLPPGFGFHPTDEELVAYYLKKKVHGHKIERDIIPEVDLYKCEPWDLPDKICLQSKNLQWHFFSPRDRKYPNGSRTNRATEAGYWKATGKDRKVTSQRSTIGTKKTLVFYMGRAPFGERTDWVMHEYHLDEKECQAAGLQDSFVLCRVVKKNGLGTKSDDQSVAPTEKNDSDGANNNTLPGILAETFCTGHQSPVLQEGENKSNLKLPSETSSENLNDMNEESVERWLDILLDDPDQNCSITSPAELTNNAKVDTAQEIQEVISSPLNWVQDFNWIPAGVDFNTPGDLEHLQFPNTLETFEEAEIIEEIFHTAQASQEDNIEANSLLLSDYLDEIWGGEEYRDEYHDTSMVQTGNHTNPEVTGIQLRQRSQICQQELPYQGTAMKRVRMQKYPVQHSAIEHQQDGCTAYSENDCIYDLQEQHILLDSFNRQNHNSKLWQNMTPLQDPVPLASARQIDAIREGHSPYHLRGPLANESLVLDIWAFPE

SEQ ID NO: 2277 - protein, 389 aa, Pinus radiata; identical to SEQ ID NO: 1583

SEQ ID NO: 2278 - protein, 388 aa, Pinus radiata
MISPELSMNFPISSCSLKRKECKADESSFKHNQDVVMPGFRFHPTEEELLEFYLRRKVEGKHFNIEVITTVDLYRYDPWELPALASNGEKELFFYVHRDRKYRNGDRPNRVTKSGYWKATGADRMVHSEVSGCIGLKKTLVFYTGKAPKGKRTSWIMTEYRLPQLETRRIQKNELSLCRVRKRSGKSEEGGFGAKEHGKGTETDRTTLNKDNVGPCLHIEMQESGSMCQWQTCMACNNIRTTVESCNLEIKAGSTDEIVKLEEMPTDIKVMPKSVTGEERYPAQMEYRVTDQSEHSQECIYSRRGNICSRVRQPISVNDELELSLTTSLICPREQDLPGMTKDLYNNNNNPSSLVLTNALTDGACLQTFTDKLWEWNPVRSNGSGASC

SEQ ID NO: 2279 - protein, 362 aa, Pinus radiata
MGRRDAEADLQLPPGFRFFPTEEELIVHYLCRKAALLPLPVPIIADVELYKYDPWHLPEKALFGEKEWYFFTPRDRKYPNGSRPNRAAGSGYWKATGADKPITSTASRGGRKRVGVKKALVFYVGKAPSGSKTNWLMHEYRLAEINRPARKKDNLRLDDWVLCRIYNRKISAEKLALEPKESFNDVPMETIDEKEMKDEPTSTSFNHSAIEQSNPSFDHLRKLGTSPTCYNAVPPGASPMNSNSCFQNMDFLQNSTTPFSGSTLKAPVQNTAFNPISSSQTNCNSTDLISGLYDDFSCSKPSSFSKPIWDKEEVESSFRLENFSQQQQQPLVNFDLEGLQNPFPHLGQLDFSDAYQDWFLCS

SEQ ID NO: 2280 - protein, 1024 aa, Pinus radiata
MEQQRQQQQQQSRWPYVEAQVPAPPNLMASADIARLLPEDALLSELMEMDGLMDTISEPWPAMASESGFSNFNFSSFIASPDSSSSFYAVCSPSAPFNAQPSGLVRADSGAMYSLPCNSSGFSPSMVNSSTTSLPQLILQEDVLMASASQDIPDKQIDDVRRSLSPSTSWEQRICKDLSSKHQEATFEQSVLDFVASDSSASEQQKQQDIMKGNFRHQLTNRPSGTVNGPRNDMNFWHLSPSLAERMHAALSFLKENYGVSVLAQVWMPVRQGERFYLTTREQPCILGGGLSGYRQVSTAYTFAAEEAPDDFPGLPGRVFMREMPEWTPNVQFYNKNEYLRVNDARDYNVRGSIAVPVFERDSRKCVAVVELVTTTEKFNFNKDIDNLCHALQKVNLRSKEIWHHPKSEHQRYSNSKCRETALAEILEVLTAVCQTHKLPLAQTWVPFRHYEIPIGEVTNTGSYGRMFLALEDQACYVGDHGMQGFRDICAEHRLEKGQGVPGKAFESNQPYFANDVKNYNVMDYPLVHHARMFCISAAVAVRLRSTHTGSDDYVLEFFLPKDCNDSSEQQVLLNSLSITMQRVCRSLRTVSDSELKGDGNRGRDYAQNDCTNFPSVGMLQRSHVPAQREPNITSFPDNQFCQEKYLQEGAVGHNSHQRQEYTSKKKLERRRGTTEKNISLHILQQYFTGSLKDAAKSIGVCPTTLKRICRQHGIARWPSRKINKVNRSLEKLRGVIDSVQGADGTLKLNAITSDIMNAASMVQGLQMHSNILPSQGSWALWPSPEDFITRKVVPVGTAVPLEETTTHQKENLNNTTQTVISTGLESPLSLKAASEVHSGCDIHMQRPSADGSISSSKNDLLARHFRESAQQGSLAYMKGQLEITEKDKNVQGFVGHEIMRNSFSSVAPFGERHQPVTYISDTSDELNSILIAKTRGFAEGIVENCQQVGHQFQGGKHDSKSLKNVENGENLSLQDVDYQVTSKHSDFFVLTNSKEPKSADVEVLRQEQNLPGFSAMTNSSAGS

SEQ ID NO: 2281 - protein, 482 aa, Pinus radiata
MKYGENLENDMDGSKQPFLQKSMPEKSRSTHGVFAMFRGSTAIAILCTLIVAMGPLQFGFTIGYSSPVQDDITSDLSLTVTQYSLFGSLSNVGAMIGAIASGKIADGIGRKGALIVAAIPSIVGWLAIAVTKNALLLYAGRLLTGFGMGAISFTVPVYIAEIAPKHLRGALGTLNQLSITIGIMLAYLFGLFVSWRLLAVIALVPSVLLLIGLFIIPESPRWLAKIGREPAFEASLRALRGPDADISVEEYEIRTAVEANQQQNRFRISDLIERRYALPLTIGIGLLLLQQLSGINAIMFYGTYIFKSAGVSSSKVANLGLGAIQVVMTAFTAWLMDKAGRRLLLMISAGGMSICLFLVGLAFLLETHVTGDSDETAYSILALTGVLVYIVSFSLGIGAIPWIIMSEILPVNVKDVGGSIATLINWLSSFAVTMTVNLLLEWSTSGTFWMYALVAAFTVLFVALWVPETKGRTLEEIQSSFQ

SEQ ID NO: 2282 - protein, 624 aa, Pinus radiata; identical to SEQ ID NO: 1315

SEQ ID NO: 2283 - protein, 1024 aa, Pinus radiata; identical to SEQ ID NO: 1606

SEQ ID NO: 2284 - protein, 540 aa, Pinus radiata
MLFPNRGTDVEKRAQWENETVGGGDTLMDDGSVHNGSVYSPGCGSGSTFGYGSSSRSSVSVDCSLKVEPDLCRIKTGSMESSDMEDRDVDFLDLRSQVGPRTDESERGKSSQKREDVELNGGKHCCGTKEHQEPQRCSKDSKFKARTGHAEDKDIENTEKNSSAVTIPVSACSGESHIGLKLGKRTYFEDISGGGQIRATPIAAFPGPLPTRVKKPHMQSARCQVEGCNADLTSSKDYHRRHKVCEIHSKSAKVMVAGLEQRFCQQCSRFHVLSEFDDAKRSCRRRLAGHNERRRKPQPDPMAVNSARFAPSFYDNRHTGLLLDASSFMHPRIFSSSVLDDRDDFKLGHGKGTWPKIVKSEVPLMFDGHPQTAAVNRPSFTNALSCQSADRLLQLLQSSKASSVSVLSQGIQHYTQNPANPLTEALTRSFSPETGVIAGLEVATATQNLLGVSDSGCALSLLSSQSLGSRALGSASLDLATRPGATLEQFMHENHSSMDQISLQGMQHNFSLANSSQASAGLISNGYPTAMNFIDKVQVG

SEQ ID NO: 2285 - protein, 1024 aa, Pinus radiata
MEAEIGRSHCEDQIYQQQKQQQRQLYASKGYNLMSKGKNIVEDHEWDGNNWEWDSNLFIARPLSTDRGSGFQGKHLLSDGPRPANGISNDMYNKGGDAYTNGFHSYNMNDASEKRRKVSVVEEEETAEEEAAACLTLKLGGSDYPVTETDADAASGGSKNGKRSRGLSASSHHHPMCQVDDCKADLNNAKDYHRRHKVCEMHAKANKALVGRLMQRFCQQCSRFHLLQEFDEGKRSCRRRLAGHNRRRRKTHPDGIMAGTCLNDDRGSYSLIVNLLKVLAQLQTSNNSDQTSNQDTVLQLLKKLASSASIPEETNAAAAKQSTAGQPNNKVSLGGPSENTVPLQNNFLDSHSNAFRKSTEPSICAREQSFVSTQTRNDVLFPHDSAQKTAVSVVPQYSHKFWQRREGIQEQHVLAGSAPQSLSIESTDKRKSPISNGFDLNNVYNGPEELVPRSDGPSTLLLLGGLDSVSRQNAPLCSSWAASDTYQTSPPQISDNSESVSDQSPSSSQGDGQDRTGRIVFKLFGKNPSEIPQVLRSQILDWLAHSPSDIESYIRPGCVVLTIYLCLSESLWEEFARGFKISLERLLGVSNSDFWKTGWIFAQLDHQIAFIYNGQVLLDISSNFANAPLLLSVTPIAVPAGEKAHIVVKGRNLTSSTSRIICAFQGKHTVQKDSTEYVQDVGVPFIDGSDDFEGCTQILCRSFSWSPHNVIGRCFIEVEGHDMSGNFFPVIVAEADVCAEIRTLERYIDMPFNSNQDVTSQNHDLQLKIKREAIKFLHELGWLFQRSCSSQSNLGILPLTRFSPTRLKWLLEYSTEHDWCSVVRKLLNIVFSSNVNSANWSAITMLIEVGILHIAVRRNCREMVEFLLTYVPESVAEETMLTAGQGQAELSSNGFVFKPDMPGPAGLTPLHIAASMENAEGVLDALTNDPGQIGVKAWTIVRDKTGMTPEDYALLRGHHFYIELVRGKSVKNVMPEHVSLDIPEPLSQQLSSIKMSVSAPRSTSQAEKIGEGNIQGNKADTELC

SEQ ID NO: 2286 - protein, 542 aa, Pinus radiata
MESGGGDHGRPPLKLSSSSQEPTMASASASAYEGRGGLVGSFVPTSSSSRVDSHMNIASTQPVDASLAMSMSSATTSNNETQISTSQQEQETVALDPNKKAPAKRSSTKDRHTKVDGRGRRIRMPATCAARVFQLTRELGHKSDGETIEWLLQHAEPAIIAATGTGTIPANYSTLNVSLRSSNSSISASHHTKALPLAFHGTLGLGPNVDMGARLDHQLRARNEWERAENRTSMELAVASNRQSEDRRLQIGGGGGEMGHGGGGDHMLGFHQENLLTDPSEHHHHMQQGGSEIGLAGGGGGGDSSDSYLRKRFREDLFKEEPTEAPKPLRRQTHEMAGPAGIPQTRPITPAMWAMASATGLASSGHMPGGFWMLPVSASSSSTPGVMAGGQSEPIWTFPPTGPSGTATMYRMPAGASIHLAGTTVGSGPTGISTLQAPLHFMPRINISGAGMGLEFQGGRLSHVPLGSMLLQQQQQQQQQHSSHQLPGAGLGLGGGETHLGMLAAFNAYNNRSMNSDHQSMDSVHQQQQGADSGDDHPANSQ

SEQ ID NO: 2287 - protein, 518 aa, Pinus radiata
MRNPGMIGYVNPAASKEQKGSNLDSAGSFTQALVMSSGVVGMGSNQGGETNNAEGSSMVVAARTSQGESGSVVDPSKKPPAKRSSTKDRHTKVDGRGRRIRMPATCAARVFQLTRELGHKSDGETIEWLLQQAEPSIIAATGTGTIPANFSTLNVSLRGSSSSISAGLKQQSYHHHHRALAGLTGGLGAPAGGDSMGHQYRMRMGEWERAEEDTKTHAGAEMGSTHGGASAALMGGGFHLQHQHQQEPNLLNEMGEGEECMNLRKRFREDLFKEGDQEASAKPLRGIVQRQSEMMSSPSGIGMGMSMSMPAAAMWAVAPAPPGMSNSGHGGFWMLQPVSAGSNSNPPPLMAAGPQSEPIWTFPPTGSTGYRMPAGTSIQLGAAAGSGSSLGRSSNNGNNNNNNGNQSRISSSTGLPFMPRMNLPMGGSCHEVSGSGSTRLGSGAVPFSSMLLQQGSSTGSIGAATGESHLGMLAALSAYNNRSMSSEHQSLQESVNQQSGVDRSGEDGHSHQNHANSQ

SEQ ID NO: 2288 - protein, 663 aa, Pinus radiata
MQSGGQYGIHDIQQLMMERGPPPRMFALSPDMLPHPMKPPGLHPHLTPHHFMPFPLDHHFQHSLATHHAQQQAMQEQIGLGDDSSENQSSFANRTAIQAETEDDDDGIEGEDDEDNGDGWATEEILNLLRISSEMHLKFRDPNLQAVAWEDVSRKLAELGYHRSAKACKEKIEQVNLTSEKAKDGKSFMQFGELEAVYNGGSRVNNGGVTNAALQEEVVAKSEQQNKKKRKRKHLTSIKIFLENLVKQLLENQEALHIKFLEAIERRDQERIMREEAWKRQEMARLTRETELRAQEHALASTREAAIVAFLQKITGEDLKLPEAPVPFHATETQEDHQAACMDKDLSDPNGKRWPKPEVQALIRLRSNLEPKFQEPGPKGPLWQEISAGMASLGFTNRSAKRCKEKWENINKYFRKTKDSMKKRPENAKTCPYFQQLDVLYRKGILSSPNKCNRVDQHSNSSDAILEDQGHGHESNHKDDLREHIQVSRSDSEHIMSVMPAEAEEITPANNNDNVYFFRSPDPVDHGHQMTKLKQNLPENNRNTSNSSSPNVESGTTTRNVGIFPTDNNKTASKMERMAKDMLEAQQQQQKKFLEEFERQEHNQNQHLHQEIRDQEFRGQQNELKLIQERSHSATQSALMALVDKLTAEIGGDFSIPLPSAKR

SEQ ID NO: 2289 - protein, 242 aa, Pinus radiata; identical to SEQ ID NO: 1613

SEQ ID NO: 2290 - protein, 414 aa, Pinus radiata
MNEPDEHAAAQLVQKRSHPLAEVVMPISVRPLAEKCGVEAEEERKRAAEHKKQRSKNWTRAETLKLIRLRAEMEPRFARSGRKSELWEEIAEALRRESVVRDAQRCRDKWEKLTASYKEVRDGQRDRQDFPFFDELDPLLSLKPQKAAAAAAAAATAATAANFVSAETPSNFPTDDEMTEEGSPAGKRRKTTPRGLSATDLDAVRELLESLVSRQQRFFVDLLDSMERKEEIRERIRQEKEEKWRAEERAQRCLFNNTMIILAKKLVDGDSGFCARDPGFCGAEEFKPKPATGGSDQTDHDGGVIVPNVGGGGGGPKKRSKNWKRAEVLRLIKFRAEMESRFAKSARRAALWEELAELLGAEGIKRDGKQCREKWDKLMAEFKDVSDGKRDRSESPYYAELTATVGTGRSAEAG

SEQ ID NO: 2291 - protein, 575 aa, Pinus radiata
MVAAAEKVGEGSAYNSPCKHLEPSPTPAHQAAQAGNISTDKASSSGVAAGGDDDVFGVGEDCERLAGGGGGSAGNRWPREETLALLKIRSEMDANFRDANLKGPLWEHVSRKLEEQGYHRDPKKCKEKFENIHKYYKRSKEGRVGRQDGKNYRFFSQLEALYSNNNNKPPQISNKAVNDASTIPNGGDRVQAHADPTSTRQDEDHNNLGGNFMVGTTSAGNTDLNSSEGISFSSDSSEDYDQPRDSNNKKRKRSGTKKLMAFFENLMKQMMEKQEKMQQTFLEALEKREEDRMMREEAWKRQEMARLNKDQELRSQERSMAASRDLALVSFLQKFTGQTLQLDTQLMDSSQIHSQGDQEQEQEQDLHDEQYKDLNCTDPNSKRWPKPEVLALIKVRSGMGSRFQETGPKGPLWEEISSQMSALGYSRSSKRCKEKWENINKYYKKTKESNKKRPENSKTCPYFYQLDALYRRGMMSNPHKMNQMHDEDLRPDDEDHQDELLEQVSGSNIRDDSGHGQGADGTGDGEILPVRPLPLPRPHSDSIAPPQTPTSNATVTLFSTPENRNADNGSLPKAS

SEQ ID NO: 2292 - protein, 371 aa, Pinus radiata
MDDTDDDARYPPNAYALQYHQSHTSNPFHRPKLPLRPAPHEHTAAFEDEEEDEEEEEEKDEEEEGNYGDDEADESENHPEAQESGTRGKNIQKTPDKPGVDRFGLRNSSPNLCPKSNPEYNLGRPEAKGSRDDWSEAATWILLETWGEKYLQAGKKSLKLEQWFEVAKTVSAASKVFKTDIQCRNRLDTLKKKYKKERQRSPDSKWVYYKYMDALLNSSPWQTGLPYGMDAGEFVSQVPLRPRICLNNSRFEEVRDGPGDSPSEEEVEEDEDEEEEEEEDEDDGGRTLKRRKEDEDSFRILADSIHRFGEIYERIENSKKRQMLDLEKMRMESDRDLEMQKRRILEQTQIELAKIKQGSDDIDASVTNMSG

SEQ ID NO: 2293 - protein, 735 aa, Pinus radiata
MVGRGPSTRVQNIFQVSPSSDHQQQQYSSQTQQHQQHHVSKNHQPQQQQQLLRQQEHRKDQMVAAAEKVGEGSAYNSPCKHLEPSPTPAHQAAQAGNISTDKASSGVAAGGDDDVFGVGEDCERLAGGGGGSAGNRWPREETLALLKIRSEMDANFRDANLKGPLWEHVSRKLEEQGYHRDPKKYKEKFENIHKYYKRSKEGRVGRQDGKNYRFFSQLEALYSNNNNKPPQISNKAVNDASTIPNGGDRVQEHADPTSTRQDEDHNNLGGNFMVGTTSAGNTDLNSSEGISFSSDSSEDYDQPRDSNNKKRKRSGTKKLMAFFENLMKQMMEKQEKMQQTFLEALEKREEDRMMREEAWKRQEMARLNKDQELRSQERSMAASRDLALVSFLQKFTGQTLQLDTQLMDSSQIHSQGDQEQEQEQDLHDEQYKDLNCTDPNSKRWPKPEVLALIKVRSGMGSRFQETGPKGPLWEEISSQMSALGYSRSSKRCKEKWENINKYYKKTKESNKKRPENSKTCPYFYQLDALYRRGMMSNPHKMNQMHDEDLRPDDEDHQDELLEQVSGSNIRDDSGHGQGADGTGDGEILPVRPLPLPRPHSDSIAPPQTPTSNATVTLFSTPENRNADNGSLPKDSVKREGLLMKEILGHMQTTPTPQHDPPSALETGSSGHNNIKKKVGLVHSVMNNLQEQGKKKQKQADLHYSASTRDANSFMEMVQKLTAADTLDFNLSASSQ

SEQ ID NO: 2294 - protein, 721 aa, Pinus radiata
MKEKGEGSEIIQAGRPQQFGLPQHQSDSMLPQFLASLTKESPHFQTSQTYENESQQSRDQTPLQPTTADTKPKDIGEFSSDLPHLVASPISSRPPAVTGTDVVFKQAIHGPDENNNNNNAADLGDDDAFGGSGGSRWPRQETLALLKIRSEMDAAFRDASLKAPLWDEVSRKLAELGFHRSAKKCKEKFENVNKYYKRTKAGRSGRQDGKTYKFFNQLEALYGNTDDTAIVDNNTSRITNIMAASVSSRRVQATPSPPPRPGWLVTTNRSEETQVPERRTSCSYRFESDEFSTESSDETHDDNNISETRSSRKRKRITTKKMMRFVEKLMERVMEKQEMMQQRFLEMIDKREQDRMIREEAWRRQENVRLSRESELRSQERALTASRDRALIAFLQKVTGQTLHLPDQFPVNSQPLSPALPQQIHPRPEEINKDNNDTDSLDPNSKRWPKQEVHGLIKLRSALEPKFHDSGPKAQLWDQISAEMAAMGYHRSAKRCKEKWENINKYFRKAKESNRERPGNNNTCPYFHQLDALYTKGILRYSNSEKFNRTRDQDQQQEELLEQTTCGSSRDDQSPGHDGDNEILAIMPPPSITTAPPASNFFSTDQPDGHVNGSQAPAPMKVMFSSVSEGLLGNSPPKPDATTIMMFQNSSQSAPPLSTTITVEDDKNKHEKQADLDLPYGVFNDRTVNSASNVSRDSSSTFMAMVVDPPQFNIPGSSHAD

SEQ ID NO: 2295 - protein, 514 aa, Pinus radiata
MYSTQSPFSSLTHPSISSQSFHIPISSSPQTPLHHHHLHIPISHSQPSLSHPNALTFQPALYHSPEVQIPQLHQVSEICEPCSISQPLCDIPSLCDQVQVQSVQYAISEAVSHPDSTYSTQNSSNPDVKGLENDRLEIVKVEEEGDGDDYKKKEKEKEHKKRSKNWTRSETLKLIRLRTELEPRFAKGGRKSELWDEIAEALQNDQISRDAQQCRDKWEKLAAGYKGVRDGIRDREDNPFFEELHTLLSGKGSRRDRGDKDHHDVQEVELPKGLLCDTGRDSVISETEINTDKRSCDFRDEEEWEVEIMASKGKKRRRPRYVSVSDLSAVKDLIETVIEKQQEFFKDLLETVERKEQMREQARQEKEEKWRAEERAERDMFNNAMMTLTQKLVGEGVGKFTAGAPVFQTLMDGNQALKKRSRNWKRAEVLQLIKIRGEMDSRFLESTRRGLLWDELAERLVAQGIKRDAKQCREKWDKLMAGYKDVVDDKKDANLSPYYAELTAMLGRENANLQ

SEQ ID NO: 2296 - protein, 414 aa, Pinus radiata
MSLRSIMREIKEVRNGIGNISRRRSFDMRVSHNHRARSQATIDDTLSRVLFVQQSQWANLPPELLHNVIQRLEASEGTWPARKNVVACAGVCKSWREITKEVVKTPEQCGKLTFPISLKQPGPRDPPMQCFIKRDRSASTYKLFLGLTPALLVENGKFLFAAKKVRHATSTDYIISLSSEDFSRASNTYVGKLRSNFLGTKFTIYDSQPPHSGAVVLTSRPSRRFYSKQVSPRVPAGSYNIANIVYELNVLGTRGPRRMQCTMHSIPASSIQVGGNAPTPTEFPRSLDESFSLPFSKEPLIDFSSSSLSEIPINVESKDVPLVLKNKAPRWHEQLQCWCLNFKGRVTVASVKNFQLVASVEPSQLVTQADQDKVILQFGKIGKDIFTMDYRYPLSAFQAFAICLSSFDTKLACE

SEQ ID NO: 2297 - protein, 414 aa, Pinus radiata; identical to SEQ ID NO: 2296

SEQ ID NO: 2298 - protein, 908 aa, Pinus radiata
MAGNEENNKMGFLDWGPLTSPTTLIASMMAEDFSSRSFSQLLAAPQIETPQSQEQNLKPLSPAGFNGSSSRSGKENDPFSISGGFAAGSVPTSGFGQVHKPPSRTGGGSFAERLAARGGFNAPRLNTARFKCLPSVSSPGGVRSPYLTIPPGLSPTTLLDSPVLLSNSQAAQSPTTGSFPLPPFLHESSLSPPVNSGSDGLKDKSYEDGTSSSFIFKPHVKSGPSSCLSPLGGLATFGSSQQQAVGGFQVQTESQTWPQFDSQMPSRSNSQGQAQMYTQIQTQAHAQSHTQAQNRTDAQVFMQAGNKARSHAAAQVKTQAQDQGQAHVPAQGQAQLWEQAVANSTGTKDLVAYSLPESPVPNNVIEEAKCVPPLQVAPPLHVDPQDFPSEESVPSEEQEQMHDSDAQLQLPEGDQKGLAPHTISGRPSEDGFNWRKYGQKQVKGSEYPRSYYKCTHPNCQVKKKVERSPHGQVTEIVYKGGHNHPKPQPSRRSAVGSAHMIQEGAESTEATTKVEGGNTWRNTELGLLKDKDAANCSKTWKNELLERSSSASVVTDLSDPSSTAQVQSSSRLDSLGTPEMSSTIASDDDMEDANDSKSVGDDGDENESDSKRRKKENNTVDIVAASRAIREPRVVVQTTSEIDILDDGYRWRKYGQKVVKGNPNPRSYYKCTNAGCPVRKHVERASHDPKAVITTYEGKHNHDVPAARNSSHDNAAKGNGAAPLAMQNNVPAPMNAIPRPVPQVQDIVSRPVPQVQGIVSRFDRHLDPRNEYVKRAYYEKVVDENLHLQDKNGGSLDLKMGAGMGFGMFGLANNHTDKRQIAEGHPPFPMQIHSTTSHGLPGIQFSGKPTVPVQSYFGQAKDNGMRFLRPKEEQNDDSGFGNTLTFNPTPNPSLYQQIMGKLSMGPSL

SEQ ID NO: 2299 - protein, 376 aa, Pinus radiata
MSWNLDIHHHRPSQALSRSSALMDIDSGLGGDFPLISFQEFLQRDEEFHDFGTHVGRPLSQIPEDQQTRHEAPEEAADFLHSGTPVAATEETRAGGRSGETSTVPGTPNSSLSSSSSEGHEESSAGIRLGPSKTEQPSEDIISTESSKPTEPEAKKQSRPRKKGQKRNREPRFAFMTKSDIDHLEDGYRWRKYGQKAVKNSPFPRSYYRCTNGKCFVKKRVERSSEDPSVVITTYEGQHTHHSPALLRGSSSGTSDQLTHFGGAADHHRTASPFNTAQSPSFNLQSLRMAVQVPQRTNYYGMGSLQAHDPIHRGSSTLQHQQQIIRSIQQQQQQQQHDHSQHQQQHQLIHSQQMQPPSVDQGLLEDIVPPGMRKNP

SEQ ID NO: 2300 - protein, 355 aa, Pinus radiata
MREINNVEEANRAGLDSSYRVLAILAQQRQQQHQDQRHDIITVSDLDMTTKEAISKFQKVVSLLGARTGHARFRRGPRQSPAYTKACMESPSYCFSQHVSPGLVSPPELSPSPAPIRQFMPSQNSAPTVFGMNAHHHRQQQLYQQQQQQQQQQQQKLHYSQLQQQQQLNFQAELMLRNNSFMKFENSISCTPTLSSTKSFMSSLSIDGSVANDKPLLTYHQLMNPVQEGGTVSSSKRKCSGKGDEAGGKCRSTGRCHCSKRRKLRVKRSIRVPAISSKLADIPPDDFSWRKYGQKPIKGSPHPRGYYKCSSVRGCPARKHVERCLEDPSMLIVTYEGEHNHSRKLSGSPNLVVHP

SEQ ID NO: 2301 - protein, 667 aa, Pinus radiata
MDYQQEQHPVTSSSHFYFPDQDLDMNSKSFSDLLADNNGDSLIWGANEQKLEFGAAGGVTRGGNSFAERFAARGGEPLKLSTAKFKTMSPSSLPIPRSPFLSIPPGLSPTTLLDSPVLLSTAQDMESPTTGTFPLQSFSFQSTAATASLDIVKNEDGSCSSFAFKPLAGSNPSSDMQPLGNLATFGYNHHQSLKGVQDDARMWTSPIFSQTNETNETGANSSSEPTTTGTTAMQAVPLQAVRSQAASFEEQQQRPLSDFNQTAIVPPTGIERPSDDGYNWRKYGQKHVKGSEFPRSYYKCTHPSCPTKKKIERSLDGHVTEIVYKGLHNHTKPQPSRRMGAAAAAAAAAARLEEGESTEGSGALVKVEDPSSTPPRRQNSNHLESLGTPEQSISASEEDDARTQVDKFSGDEDLDEEESDSKRRKKEVNTMDIIGATRTIREPRVVVQTTSDIDILDDGYRWRKYGQKVVKGNPNPRSYYKCTNAGCSVRKHVERASHDPKAVITTYEGKHNHDVPAPRNSSHTNAGLGSGQPPVPILQNSVAPSTNGMALTAPGTQETFSHFDRHPDLHNGYGNNNYMFGRIANESYNSQNGRGLGMSLGAFGLESKHSEIQQAEAPTSFPMQIKPASHEYSSIGSGNSGHIYYNQPNERDGLIRPKEEQKGQFLV

SEQ ID NO: 2302 - protein, 462 aa, Pinus radiata
MPRIWVVHPQEAQKNISSMDLEGDLGAVVRATRKGCARIDELDFDSCNLLNAGAVLEPKKEVTVPISISISDTVTYSPFYGCNPSRSNKSLLPSMFENLDHYYHNVEQKPAWCCGTAPDSSLGKAEKKDAAHDLIMAATTSTITTSNNQEQASGRINVGGVCPRQSLSPVHVKSPPRSPTRQDDPSAKTPDKVEADCSSSSPIKTESTAERIVSNRATASGTRGGRRNQQRRTVSIAATEGSWNKPGGGGVASDLWAWRKYGQKPIKGSPYPRGYYRCSSCKGCPARKQVERSHTDPTKLVITYTAEHNHAWPTSNPRNGLALTGSLSSTQKDMMALVVPHSPQKSDVLPDARGSNPAASPTTAKIEQEKPRSPPATDCLDFNLTEETTDCLVEDHNQTAGLHMISSNHVNYDDLFAGLGELKDFARYFSDYKSDEETDSTVVDPYNLFNLSSASSNKTTAD

SEQ ID NO: 2303 - protein, 691 aa, Pinus radiata
MGEELLFDRFREHNWRLFSGTDQAGGLLAFRNMMMNGAGRFEHKTTTGIDLSVKLEEDDDGGRSVQENGSHGGAEKDNGYDNRTAEKDFFHHEVGRLSFRLLPVDGESKAEDGTADMMSQGPEDEDDKPATNVSTGLRLVNVQAARNAASDRSTVEMEDCASPINSQETSNPNDMDGEPNSELVVVQKELNRMNEENQRLRFMLNQINSSYNNLQLQLASLMKQQPQNYGHAVREQVHKEEKLNIFRGITGNNNGEAADDQTQTPIQRQFLEIKDLSRLNSGTIAHEDSHTSEARRTLTHAENDQEESKALMAFNHIDNKRARDHDSHGLTSKGHDSPDRTPSPNPSPTHHENVGTPQREGSLDRRSSPGWVPNKMQKIVDQTDATIRKARVSVRARTESPMISDGCQWRKYGQKMAKGNPCPRAYYRCTMSPCCPVRKQVQRLAEDRSILITTYEGSHNHMLPPAATAMASTTAAAASMLLSGSSTSADNIALNASFMAGALMQHPCNTSTASISASAPFPTITLDLTHNPNQMANAPGHMAASNPRALAGLPAHAMPFVGMPHQFPTNTPQGALFHGQSIYNAPSMFAPLAGQLQRPQQPMMPTPPKLNIQAGQPPTPQQQQPSFIDTVSAATAAITSDPNFTAALAAAITSLINNNNNAANAISKPNSSQALNPSPQVAAHVKSDHTQ

SEQ ID NO: 2304 - protein, 642 aa, Pinus radiata
MEAVGLSLAGNGSYRELLDTFLKQKCRRKGDFMADAPRVDRLGGIDLSVKLEETENEEKLMTDRESENEIKNGVVDFFSEKAVRGLGFEFRPSPGNGAPSVASLGEGLRLGSQKTENKEEGPSSSSSKGFNLSLLPAKTGSDRSTVEDGMSPVRSQEPSNPDEGEPKSELMMLQVELNRMNEENQRLRFMLNYVSKNYGNLQMHLMSVMQQQPPPEKVEEKLNGSSEGVKVDVAGPVQRQFLDLVPISSHGTDSQHSLSSDTRDADDVEETAKSINNEVLSKKRDVATANSTDKPRTCDVRVQQQQQQPGTDPAANSSTALNAQEKGHPDSPDHESWTANKAQKVANKCAVDQTEATIRKARVSVRARSEAPMISDGCQWRKYGQKMAKGNPCPRAYYRCTMAVGCPVRKQVQRCAEDRSVLVTTYEGSHNHPLPPAATAMASTTSAAACMLLSGSTTSNDGGFNSSFMQAAAGSLMSCSPASMATISASAPFPTVTLDLTQNPNPNMYHRQPSGFPMPLGGFQQLPSHPPQIFSHSLFNTSKFAPLSGQQFDPQQQQVPHFSGHPMQQQTHMPVPISQYKAPQSSLMDTVSAITADPNFTAALAAAITSIISGQSNNANTIPSQAPPCARADNPASAKLLQ

SEQ ID NO: 2305 - DNA, 973 bp, Eucalyptus sp.
ctcgtcctcctcctccgccgccgccgccacctccgcctccgcctccgcctcctcaatgtccttcctcgatgaattccaagcagacctcgaagcgctgcccaacatactgcagaagaagtacgcgctgttgcgcgatctcgacaagagtctagaggacctcagaagacagaatgagcaacgctgtgagcaagaaattgaggaaattaagcagggagttaagtcaggtaacacattctcggatgaagtgctagatgagcaaagacatagcataaggattgccgatgagaaggtcgctttggctgtccacgcgtatgatttggtagatacacacatacaacagttggatcaatatctgaaaaagtgtaatgaggagctccgacgcgataaagagagtgttcctccagaggggatatctagttccagtgttgatgcttctacgaagcctggcaggggtagcgaatctggtagaggaggacgcaagaacactcgcctggctacccaagcagcaacagaagccactaatgcagcttctacaaatcctcctggtatggagttggatatacccatagaccctaatgagcccacatactgtttttgcaaccaagttagctttggagaaatggtcgcgtgcgacaatcccgactgcaagatagagtggttccattatggctgcgtcggactgaaagatgtgccgaaaggaaaatggtattgttcggactgcgcaggtctgaagagtcgcaggaaaggacggtgatgatgacaatattgaagagattctatcccttgtaatttaggatttgtacattctgttcttttaaatctttacctgtagcctgtagcttcggctttagttggacgtaaatgaatcctgaccttgttctcgcattcaaaaaatgtttgtccgagcgatactagcagaccttgttgtaccttttgccaatgcaaaaaccaaatttataacagaaaaaccggc

SEQ ID NO: 2306 - DNA, 942 bp, Eucalyptus sp.
tctctctctcttcgtttctcccgtttctctctctctacctctcgccaagaaaccgccaggaaaggaaggaaggtaaaaagaaaagaaaaggaagccatggctccgagagaaaagcccagcgtcgccgccatcccaaaccctaacggcgctaaggaaatccgtttccggggcgtccggaagaggccctggggccgctacgccgccgagatccgggaccccggcaagaagacccgggtgtggctcggcaccttcgacacagccgaggaggccgcccgcgcctacgacaccgccgcccgcgagttccgcggcgccaaggccaagaccaacttccccacctccgccgagctgatctcctcctcccgcagccccagccagagcagctccctcgacgagccctcccccccgccgccggccggggccgtccaggccgccgccctcggcccgcccctcgacctcagcctcggcggagtacgacaggccggcgcgcggcaaatcgctcctcgacctcaacctccccccaccggaggtggcctgaaatttttccccgcgtagatcggcggatcgggacgatggaatttttggatccttttgttttttggttgttggtttcatcggtttgttaaggacgtgctctcagcctgatgcaagatccatgctctgctgctgacgacaacgacggacgacgacgacgccgacggacgacgatagaatcatgtacatagaaaagactatgacgatgacgatgacgatgatgattaacctcctacttgttgcctcttttttgcaactgagaaaagcgaaaagactagggttttctcgatgttgtttttgggttctttgcttccaccataaatgaaatcggcgatgtcattttcggcacgagagtacttcgagagcggccgcgggcccatcgattttccgcacgggtgggtaccaggtaag

SEQ ID NO: 2307 - DNA, 1840 bp, Eucalyptus sp.; identical to SEQ ID NO: 1645

SEQ ID NO: 2308 - DNA, 1203 bp, Eucalyptus sp.; identical to SEQ ID NO: 1787

SEQ ID NO: 2309 - DNA, 2487 bp, Eucalyptus sp.
atcgctggagaaatcggattgacttgcctttgaattcctcctcctccggggaaaattccacaccgaacttccgctttgggggggccgccggaaatctagggctccgctccgccgtcctcctccgtcgtccgcaggtccatctcggtttcaaatgctgttatatttttgatccaacatattgtcggagagcaatagaatctggcgttatgcagccaaaatctaaaatttcaaacggggtagatgctcatccacatagcatccagactagtgcagtattcactgaaccctggtggcgtggctataatactatttccccagctgacccaggaagaaacgaaacccatgcgcctttaggatgcataaatggtggttcagagtccaatggtggtcaatcacagtcaaatgaggaaagggttgaggaagatgatgatgacgataatgtcaaaggatcagggaaccctgcatgttcaggagcagttggaaatcaaggacaagggcctcaaaacgggcatggtgctcccactattattacaatgcgtgatgatggccttgcacaacctccccagctagagcttgttggtcacacaatcgcatgtgcatctaatccttatcaagatccatattatggggggttgatggcacaatatgggcatcagtcaatggttcgtacccctcagatctcattcaatacaacaccgacctattatgcgctagctttcattccggtgcatgcacagttatcacaaattgtatttagaaaaagaatccgaaaagtccgtttcttctggtagattggaagaagaaatatgtgaggaagtagtaagtctggcctttatgctacctcttttaatatagtttttcttttagcttttgaatgcttccttcatttccattggagcagtcctaaattgcagattgcttcatcaatcgtataatatttatagaggtgacattcaagttcatagatgctaggactagatgacaagaaacataggtccttggtgataggggtgctggtgaactaactaggtagctgctccatcggtgatgctggtgctgttgagattatgtagcttgttgggtaggtatattatctactgctgaagtagtaatagcttttcatgaatctcagtaacgcaatatgcatatgtcaccagtatatacttcctaggactagggtatatgggtaattgcgcaggtaagctagaaatgtcaattttgaaaagaaatcaaaaattgacgctcagctttgcttctcacgcattgggcattgtgatgctttaaatcatttatctagactttaggtctttttggatctctatggtgcttgtttcttctatttgtcaagttatatctggtagttggtgctactagagggtgagatgaagagaaaacatatgagaggtaatctttgttacacttctaacaatttttttatgttcatctttaataatgttcactggaaattgctatttttgtgccttagagctctcttgtgcacctcttgtttatgttgtatgaggtgctctgttacacaatagatacatatctgaattctggaatatgccatctgagagatcttggattgggcaggcttatccttttgtcggtattcctcatgctaggatgcctctgccccttgacctggcacaagagcctgtttatgtaaatgctaaacagtttcaggggattttgagacgaagacaagctcgtgctaaagctgagcttgaaaagaagctgatcaaagttagaaagccgtatcttcatgagtcacggcaccagcatgccatgagaagagccaggggaactggagggcgctttgctaagaaaagtgaaaccgatgcttcgaatgatgcagctgaagagaagggcacaaactctggtccggctctgtcctcccaatctgccagttcatcgggctctgagcctttggcacctgactcctctgaaacctggaattcatctagtaatcacgtggcaggaaggtcgcaagtgcatggaactcacagaggtcatgactacgtgaatgggaacagccagtacaaaaatcacggccacttccaggcctcagcatattcaaatgaaagggagagagatcgctttggccagcaacccagagagcgtcttctctagcggggttcacgaaagcctgcgtgggccccgtggtgcaggtattgggcccaccactaattacgtaagaaggctggtggcatggtttcgatcccgcaattcttggcaatctgtttgcggggcggcaattcattcttggcttttgttctttgtgtttatggtggcttgttggataaaaggaggtgccgaggaggagatgaagaacatgggcatgtgagtttctggatgtccactttttcattttcccccaacctaccttgttcttttagtcgtgtacaggagtaggtctctctgttgtgaactttagaccaaaattttagcttccagtcagacagaacatccttcttaaaaaaaaaa

SEQ ID NO: 2310 - DNA, 1270 bp, Eucalyptus sp.
agagagagagagagagagagagagagagagagagagagacccgggtattgacttcgatcgcgtgttttcctgattgacaggatttagagccggctccgtggggacgctgaagcgaaggggaggaagaaaggaagcagcagcagcagcagcagaccagtaaaagctcttcaatacagagtctcttccttgtgctctggcatggatcagcaagggaatgggcagaccccggccataggggttagcagtagtgctcagatgtcatatggtttgagcccatatcaacccaatcaaatggcaggcggggctcctcctggatctgccggacaaatgcaacctcctcagcctgcttcttcagcgcaacttgcacagcatcagcttgcatatcagcacatccaccagcaacagcagcaacaactacagcagcagcttcagaacttctggaccaatcagtatcaggaaattgagcagaccactgacttcaagaaccacagcctgccgttagctcgaatcaagaagatcatgaaagctgatgaggacgtgaggatgatatctgctgaagctccagtcatatttgccagggcttgtgagatgttcattctggagctgaccctccgttcctggaatcacacggaggagaacaagaggaggaccctccagaagaatgacattgcggcagcaatcacgaggactgatatttttgatttcttggttgatatcgtgcccagagaggatttgagagatgaagtacttgcatcgatgccgagggcaggaggtcttcctgtgggtcctccggccgaaggcgttccttactactatgtgccatctcagcatggtccacaaatgggtgttcctcctggagtcattgctagtaggcctgtgacggatcagtctatgtacagccaacagcctcacccttacatggctcctccaatgtggccgcagcaacagccgcaacaacagcagccgcctgcagattcttgagcaaggccgtggccaagtttgtgagtcaatcatcaggttgaaggttgaagcgtaggagcttcttgtgttgccaaggggagaccgcggtgggtctgagtggcctggctgttgtgtgtatattattactgccctatcattagcttcttttcttgggttgtagtagtatgtgtatagttaatgtaacttagtttgccgaattccttgccgcttttagtttgccgaattccttgccgctttatttccctttgatgacatctaatcctgctttttcccccctgcaaaaaaaaaa

SEQ ID NO: 2311 - DNA, 2122 bp, Eucalyptus sp.
cgttagcgaaattactcttctctccctctaaccctctctctccctcggcttcacgtccatggcttcccccccgattcccgcagaaccctagaaaatccgccctcctcccctccccaatcccccccttgaacctcatcgcctcagctcccgatggacggtgccggcgacgacggcgcaggcggcgcctccaagcagagcaacgccccggcggcggcccctactcccgcgcccgcgccgatgtcgagcgcgaacgcgccaccgcctttcctgagcaagacgtacgacatggtggacgacccggcgacggactcgatcgtgtcgtggagcgccacgaacaacagcttcgtggtgtggaagccggcggagttcgctagggatttgttgcccaagtatttcaagcacaacaacttctccagcttcgttcgccagctcaacacttacggtttccggaaagttgatccagatcgctgggaatttgcaaatgagggtttcctgaggggtcagaaacaccttttaaaaagtataagtagacgaaaacccgtgcatggacagggcagtcaacagccgcagcaaccacctggacagagttcttcagttggggcatgtgtagaggttggcaagtttgggcttgaggaagaagttgaaaggctcaaaagggacaaaaatgtgctcatgacagagcttgtgaggttgagacagcagcagcaggccactgatggccaactgcaaacgatggtccaacgactccatgggatggaacaacgacagcagcagatgatgtcattcctagcaaaagctgtgcagagcccgggtttctttgctcagtttgtacagcaacaaaatgagagcaacaggcgcatcactgaagtgaataagaaacgcagactaaggcgagatggcttatctgagaatgagcatactgctgcttctgatggacagattgttaagtaccagcctccaataaatgagactgccaaagcattgttcaggcagatgatgaaagtagaagctcctcagcaggagtcttttgacgatagtccagagagttttcttctcggtgatggttcatctctgtccagtggcatggacagtaggacttcgagtcgcatctctggggtgactcttcaggaggtcccgccaacttctagccaggttcctgagattccaccagctttgggggcctcagcaaatgatccctcatctgccgtatctgaactaaaggctccgtcacagggtactgctaaggtcactactaaccagtttccagatatgggtatgctcgcaggagcacaggagtctgaagcagtctccgttaatcaggcagataccgttatgactgggatctctcaaacacaagacatggtgctggaggatattgctaatatatccagagatgactacatgggagcagatctgcataatggtgattacatggatcctgcatcatttatgaacgggtcgatgcctatagagatcgatagcatttcccctgaccccgacattgatgctttgttagagagttccaccttctgggatgatcttcttatgcagaaccttttaccggaggagggtgaatcaacttcagcagaagctcatgctggggctaacgacgcgcagccgatggagaatggatgggacaaagccgagcacatggatcagcttactgaacagatgggcctcctcgcatctgataacaaggggatttgaccttatacaaattttcagtctgttcccaccatagctcaggttgaaagattgatcgttggtgagaggggctcattttggccttccccaagagcatatcgggcatccgagtattcatacatatacaagccttttctggatgtcacgggccccaaactctgcacatcattttgatacttgagctctggtggaagaaggggccataagtcggatagcttagttaaggggtactacagcttcagtttagtcggctcttagatggaaagaatataaaggatggacgtttgccgagctaaagcgttgctgaagaagtattgtataatttgttaatttgttaagctgatgaaaaccccttctctaatcgtatgtctcatttgagatttatgtccattggtttttcacctttttaaaaaaaaaa

SEQ ID NO: 2312 - DNA, 876 bp, Eucalyptus sp.
agagagaatggcattcgcaggaacaacccagaagtgcatggcctgtgagaagacagtctatctggtggacaagctcacagctgacaatagaatctaccacaaggcctgcttcagatgccaccattgcaaagggactctcaagcttgggaactataattcatttgaaggagtcttgtactgccggccgcatttcgatcagctcttcaagagaactggcagcctcgaaaaaagctttgaaggaacccccaagattgcaaagccagagaaacccgtcgatggagagagacctgcagcgaccaaagcctccagtatgttcgggggaacgcgagacaaatgtgtaggctgtaagagcaccgtctacccgaccgaaaaggtgacggttaatgggactccataccacaagagctgcttcaaatgcacccacggggggtgcgtgatcagcccatccaactacgtcgcgcacgaggggaaactctactgcaggcaccaccacactcagctcataaaggagaagggcaatctcagccaactcgagggcgatcatgagagggaaacaatggctcctgaatcataaaacgctttgatcttgcactaccttgttcgttgagctgtcaccacactttgtggccagcggatttcaggctggtccaaaaacctgttatgctattagagaatctatgtccatctactaaatttgagatgtgtgagccttgaccggtttgatttggcttctgttttgcgattgcggatgatttctcgggttggttgtaagcgtagaataagtggtgcttgcttcttgactttgtgaaacctctgagcttgctttcttttcagtttgtccagcgagtgtgtctagcatcatccctaaaaaaaaaa

SEQ ID NO: 2313 - DNA, 2908 bp, Eucalyptus sp.; identical to SEQ ID NO: 42

SEQ ID NO: 2314 - DNA, 1106 bp, Eucalyptus sp.
cgtcactggtcaatggtcatgcgctgaagctttctacctttaatgcaagcatcgatcgtctcggcgacgtgctctgcttcctcttcactgctggtcagttcatatgcatccacgcgtagttgtcttcaagcgacgcatgcactgattgaagcgtcctcataggcttgtgagatgatccaagacctttcactgcttgtgatactctttataaaggacgagggatggtcttgatgaatcagatctcttaccctcaaatggcaggaatgataccttctcgactgcctctgccctttgatacgacacaagaagaaccggtctatgtaaatgcaaaacagtatcatggtattctccggagaagacagtaccgcgcaaagctcggggctgaaaacaagctcatcaaggatagaaagccttaccttcacgaatctcggcatcatcatgcagtaagaaggccaaggggatccggtgggcgttttctctcaaaggatcagaaagaatcaaaatttacctcccttaatgatgaatcaaacgtcaaaagcaccgcaagggtgtcttcagccatcgatttaccgaattcagaggtgtgtcagctgaaagatcacagagacaccggctccaccacctcttgctccaaaacgactcaaaccaccaccagcagtgacgccatcccggtgtcaaaattcaggttctttggtcaaccttggcatgtgatgaccacgtgtgatccttcttgtgacgttcgttatagtggggatattcgccatctttctctgccaggtgaaagatgagtcggaacaacaatcacagtcgtcagctctgtgaatctggcgcttgagtggagaaagtacagctgctggtttcaatgggaagtcatccttggctctgttaccgttgcttcttattaggtagcttttttaaaactattttaactgccaggctagtcaaaacatacaaagcctgcggattgtggtctctgttacgagactgtcgtccttaataagcttattaagcgcacgaagaacacacgccctgatggtgtaacttgaaagtgtcgagcagccgtcattatgctaagcacgtgagttgtttgcctgataaaaaaaaaa

SEQ ID NO: 2315 - DNA, 1817 bp, Eucalyptus sp.
cgtgtctgcccgagggaacgccggaaaatggcgagccccggttcgaggacgccggccggcgagagggccgtcgtgccctgcgacttctgcaccgaccggcccgccgtcctctactgccggagcgacgccgccaagctctgcctcctctgcgaccgccacgtccactccgccaacctcctctcccgcaagcacctccgctcccagatctgcgacaactgcggcgccgccccggcctccgaccgctgctccaccgacaaactcgacctctgccaggactgcgactgggacgcacacgccgcctcccccgtcgcctcctcccaccaccgcgcccggatcgacggcttctccggctgcccctcccccctcgacctcgcctccctctggggcctcgatttggccgacgggggcaagaagtcgtcggccatcgcccggaacgacggcggccagctgatgcaggaggtgatctcgagcatggagggttgggcgtacggggccggtgcaaacgggttcggcttccaggacctgatggtgccgaacgacgcgggtttggcggctccttacccaggcgccgtcaagcagggatcgacggcgggtcggacgagctgcgggaggcgcaagcaggagatgcacaggcagttggtggagctgctgaatggggattttgaggacaattctgatggcgggggcggcgcaggaggcggaggcagcggagagggaggagataatttggtgcccaggacgccgaataggacggcggccgcatggccggagaatggggaagggatttgtggggagcaacggcacgggagcgatggggtcgatgcggtggtggtggatcatcatcagccatttcaacagcagcccactttcacttctttgctgatgttcccgacgcagcgggatttggaggagagcggacggggcgtcgtcggagcggggactagtaatgttggcggccagagcactcaggttcggatatcgattgtgttttcgctcggtttcacttgatttctagcctttctggcaggtcagttagatttgggatttcaacttgggacggttgaggagtcaagaagaagctagtgcagtagaagttggatatggccaaaacagtgaaggttttatgatcaagagttacaatgaactaatgaaagacacatcaatcacaactacaaaaatgttgggagatgtgtaccagctgaatggttatgtcatgcccaaggatatttcgtcgtataatgtaagccagttcaagtaacctggctgctagccaagggccagcaacatccgagagtaacaacttacccgtgtccgggccatcatctggttcagctctagctaaagccaaaggttctactgactccaagggttacaattttgtggatcagacattgatcacctatggcaatgacatgaaaacgatggtgaagacaaaggctgacttggagttgctggctcaaaacagaggcaacgccatgctccgttacaaggagaagaagaaaaaccggagatacgacaagcacataaggtacgagtcaaggaaggcgagagccgacactcggaagcgagtcaagggtcggtttgtgaaggctagcgaagccccttgaattgggttgcctgcagtagccagatgagctgctccctttactctctctctctctctctcttttcccttaattctttgtttgcttgtaaataaccttttacgatcaatctctccccatgttgtagtgtatgaattgagcaagtcttagattacgtgtgtttgctgtcattactcaatagtcatccaatccttttcatctttaaaaaaaaaa

SEQ ID NO: 2316 - DNA, 2867 bp, Eucalyptus sp.
ctttaatctgtcttgactctgtctgagctggttcatatcaagaatctcagacactctgacacaatcacagagagagagagagagagagagacagagagagagaattggtctctgtctcatcaccaagaaccaagaaagcccctgaagatttgtgctcttgaatcttgacctgtttgttgggtctgagtttgagagttgaggtttctgcttctttttttcggctgtgggagtgcctaaagtttgaaagatcttgagatagatagatggctacgttttcagggaccacacaaaagtgcaaggcatgtgagaagactgtctattttgttgaacagcttacagctgacaacaaggtctatcacaggacttgcttcagatgccatcactgcaagggcactctaaaggtatatgaaccaatctctagttcctttgctttcttttagttgatcacatctccaatgaacctcttttgttggattttctcaactctggttcgtctcagttttgatggagaggtgatggatggaagggatccaacttgtctttacaaactttttagcttgttatttgtgtgaaggttggagaatttgcagaggcggggagcaattagagatgcgtgtttctatttacacgatatttaattattgaattgggttattattggaaagcttaaacttttagattgttagtgggacgattgtgcaaaattctgtgtgttattgaagtaggaggtcccgtgtttgaatctttaaaggcccaacaataaagaccgatgtttcatttttaggtcaaatcatagcctacatgtgaggaagtgttataatgtatgatattgaatcaggccttcattgacaactgaagttttaaccggtctgccacaaaattctttatataaatcaagttgtgtaggttgctatctttatttatgatgtgaaaaaaattgagatttcccttctactgaggtactgtgaattaaaacttgagcttcttatggaaaatcaagtggaattcaaggataggtatgtagtgatcaacaaaaactttctatcaccggaattattgtcatcaatatgtccggggcttgtggctcatggcctgtgagcaagaaatgaggttgttatcagagaatgcaggaagattgttgggactggtgttgtctcagccactggagtattgctaggaacttcttgactagatcgaaagctcttcatcatgtacgtgatcaaagtgcctatctttcaagactgcatcgaatgtcttatctcttcaactgcccatgccaagatttgacgcaaacatttgattgatctcattgtccttagctttataacggaatttggtcaagttggatcaagttttgctcatctttatcttatcttttgcttctgtgatgattacatctgtaaatctctaatattcttctcatttcctgaagctgagtaactactcctcctttgagggcgtattatattgcaagccccactttgatcaactgtttaagatgactggcagcctgaataaaagttttgaaggtactccgagaactgtcaataaatctgatcaggtacaaacaaacagcaaagtctcgagattcttttctggaacccaagagaagtgtgttgcatgcaaaaagactgtttatccaattgaaaaggtggcagttgatggaacatcatatcataaagcttgttttaggtgcagccatggaggttgtgttattagcccatcaaactacatcactcatctgaatcgcctctactgtaagcaccaccataaccaactttttaaggtaaaggggaactttagccagctagacaagcatgcaaaaatagaagaggtacctaagttgccagttgccgaagttgcagagtaaactccacttatattctttaatacgctcctctgagcaactaagtctgatagtatgtctcaattaatgcgtggatgattgattagttaggggtcccagaagagatgatgaatgggcatcatttccttctaaaacacaaaccacatcattatctgtttactcacaggtttttcagtttgtggcttaatcttttggtttgagaatttgggcaaggtcagtgaggtttgaaaaagacaatgatcagggagacagtattgagatctttatattatagatttgaggtttgtgtattattgtagtgtgaagcggttttgctttctcccagtatgaaatcaactctctgaggccaacacagacttatctagtttgttattttcactttctattttccaagtctacaattttcatgaaattatgtacatgatctgatctgattaaaatgtgaaggtttgcacatgacagattctgatcaaatgtagaggtttgcacatgacagattctgatcaaatgtgactagttcacaatttagcctacttatgtatattaatgtctaagaaacaaactcttctccatcagtttcataacagttttgtcctgcataaagtcaactcgtaatcgagctgctgagaagcaattctgcatataaagatgcagaaatgaaatgcggtggaccatcagaactcaaaagaacatgtgagagaagaaaatagctttattgttttttcagtggatctccactgctgaatattcatcatttggtctattatagaagagaaagatagtggttcttacttcttataagcaaataggcctgtatcatgctaaatacacactagaaatcagttgtcaagtgcagaacgatgatacggcacgtggtcaatcagagtgatgcaagttacacggatgggaaatatttgtttaggttgaagggcagtgagtagaactcttgacttcttgtatcaccactgaatgacttgaacttgtccccccaaaaaaaaaa

SEQ ID NO: 2317 - DNA, 2115 bp, Eucalyptus sp.
ggagaagcctgcggggagcccgtgcggggtggtgaagtgggagcggttcctgccgaggatggtgctgcgggtgctgctcgtcgaggccgacgactccaccaggcagatcatcgccgcgctcctcaggaaatgcagctacaaagttgcagctgttcccgatggtttgaaggcttgggagttactgaagggaagacctcacagcatcgatctcatattgaccgaagtggatttgccatcaatatctggatatcctcttcttactctaatcatggagcatgatatatgcaaaaatattccagtcataatgatgtccacacaggatgctgtcggcacggtgtacaagtgcatgttgagaggtgctgctgactatcttgtcaagcctattaggagaaatgaattgaagaacttgtggcaacatgtttggagaagacaaagcccagtcaactgccagtgcaagtggccaagaagatgagactaatgcattgcagaaggtcgaagcaactgctgaaaataatgctacgagtaatcagtcaagtgggtacatggcttgtgtcgagagagacaaggaattgattgagaaaggaagcgatgctcagagttcttgtacaaagccagacttggaagctgaggttacagaaatagaacaggtgccagatttttctcggcctgggtgggacaagtcttctgtgaatgacaataaggtagcaatgcccgaagagaaaatgaaatcaactcaggaaggacttgtattgcaagaggatgctgatgttgctatggtggatgcccacagaagttctcatgcattgactcagatcaaggatgccaggtctgaagttcacaggggggatgaaaatgctgctagtgattggtgtggtgataatgatggaataatgaactcatatagacaagcgatcaacttaattggagcatttgagaataattcacatgtctgttatgttgatcgtccatccaattatggcatgagacagtcagacttatcaacgcacctggatctttccttgaaaagatctgatcctagcgcgtttggaaatcatgaagagaggcaaacactcaagcattctgatgcttcggcattttcacggtatgtgaacaagtcttcgcaaccattgcggccacagtcaattaatgttcctattcggcagatggcccgtggaagcaaccctgataaagaggctttgcatgttgctgatgatagtaagcctgacactcctgttcctgtgcaaagcactccaatgagtatgattgcatcaggaagcactcaatctaggcagtccgaatacttcctttcgtgccctccgcagagtggttttccggctcccattccggtgagaggtgtcaggtttgacaatctaagcacggattatggttccgtgtttcctcgagtacactgtgggcaatcagttccctcaccagtgccaagtccaagtactgctggccagcaagatgctttcttcctcactgaatcgcttcatcagtcaagttgtgaaaataataattgtgatcgcgcacaaaacccacttgatcaaaacacaagcaactcctccaaccagagtaggtacaaacaggagtttaagtttgattcattggaggatcgaggacatatttcacccggtacggacaggagtgcaactagcagcttctgcaatggcacattaactcggcttagtagtcttgactgtggaagtatctcaggaagtaatggcaatataaatcaggtctctgcaacgaggcatgctggtgagagcatcggtggagatagtcttgttgctcaagatggaagctctcgacgagctacgcagagagaagcagctttagcgaagtttcgcatgaagcgaaaagatagatgctatgaaaagaaggtgaatacttttactttggtccttttttaatgagtacaagatgtcaccatatttgcctacttgatgcctatttccttttggtgcgagacctaattgtttaacttaaaaactgatgggtataacagggatttttcatgtggaaaatgaatatcaggccttgaaaatttattccctgggggagttccctggaatcagtgtgaaaacttgagcatttttaataatcccattgaacttg

SEQ ID NO: 2318 - DNA, 1243 bp, Eucalyptus sp.
ctttctttaaattttagctgcaccagagattctctccatcccaccctcccctctcctctttcaagtcaaagaagaaagaaagcaagaaaagaaaagaaaattctctagaaaagaaaagttggtgtggattgagagagatgggaaaagaaaaggcaagagagccagagaccgagtaagcgagggcatatattcccctaccccaacattgccccactcgtgtttccagatatggagtgaaggaacataggacagcccaacaactccacaaattttatatagagaaccacagacacctcccaccataatcaaaccaaagcttaggcagccaaggaaagaagaaggatcagagacccaaaacactcctcctaatcctatatttatgtttctgtcatcacccatcctctgtctctcactcccatcatcctacagacaacagctcaaatgggtctgcaaaatcatcagaagatgaatctggtgctgtccactgacgcaaagcccaggttgaagtggactcccgagctacatcaccggtttgtcgaggcggtcatgcagctgggcggagcagacaaggcaaccccgaaaagtttgatgagagcgatgggcattcctgggctgactttgtaccacctgaagagccatttacagaagtacaggcttggaaaaagccaacagtcagagtcctgcattgacacgaagcaagaaggcgaattctatgcaacagaaaacaaagaggttcagggtgcagacgaatatcaaaataccgaaataatcgatccatcgaccttccaaatgaatgaaagcttgcagatagctcaggctctccaaatgcaaatggaagtgcagaggaaacttcatgaacaaattgaggtacagaagcatttgcagctacgcatcgaggctcagggcaagtatctccaatctgtactgagaaaagctcaggaaacattagctcggtacaataattccccggttggcattgacgctgcaaaagccgaactgtctcaattagtttcgatggttagctctggttgccccggttctcctttctcggaactgacggaattaggaagttcagacctcaatgatgcagctaggaaacaattaaaaggtatatgctcagtagaaagttcgttaacttcttctgagagctcggggtcgaaatgaagagaagccaaaaggcaatgagcatggcaaaatgcacaactttagtcccacttcaattgagcttcggttaagtaacata

SEQ ID NO: 2319 - DNA, 1727 bp, Eucalyptus sp.
ttaggttattcgtgagctcacacacgctatttaaaatgactcatctcttgatgctcccttcgattggaaacagcaccgaaagagaaaaaacccctgtagccgagaccggttttggagcttccaagccatgtcttctcgcgagcaaaggagagcggctctctatgagaagttgcagcaactgcgcgccgtcaccaactccagtgcggtgaataaaacttcaatcatcgtggatgcagccaagtacatagaggaaatgaaggaaaagatagacaagctaaacgaagagctcggaacttcaacagatcaagatctacccatggtatgcgtttgtatgtatagtcgatgacatgctcgaaataatgcaaagcacatattgcaatagtagcggacctttattaggtttacttacacggagagaaccttttacgcaagcccttaatggtcttgtgacacgatagaagactcgattactgtaacggccttaattgctaaatccatgtcatacctttctactgtgctaattggaaagttctttcctctgctataaatggatctaaaatactaacggtttcttaagaatcttacatacttatggttgaaattgtaatatatatggattgggttgagtttttcaggaggttaatgtggaaagcctagagagggggttccgaataaacgtgtattcggaaaagaactgtccaggtttgctcgtttccatacttgaagcctttgaggagctggggctcaacgttttggatgctagggtttcttgtgctgacaatttccatttagaagcagttggaggagaagtaaggaatagaaaaattccaaatcttagtgtcttcatttattcttgtccaaattttagtgtcttcatttattcatgatttaatgttcaatcactccatatacgaaaacttgcactgaaattgacttctccatagcatacaatggtggtggaaaaatttgtctgcagaagtgcttgatctcatgaaaatgtgtttgctataagatggatagtcacttatataaacttaataatgcacacgtggagttgactcctcgtgaaacatgccttaccctggaggtgttctctataataatcattgagatatatagacatgtctattgatcaaattgacttcacgtcttatttcccccttgcgaccacactccttttctagtttacatgcagtgcggtttctgatggcgcggtttgattacctccaccatagtgcgtcccagtgttaaccaaaaaaaaattaatactgaattagttgcttaagatgcacacatcgaaattcattttgtttacttgcaagaggatatttttatctttctttgtgaatgttaagtgcaaattaccgggtacttttgcaggaagatgggcatgacaacattgacgctcaagtggtgaagcaggcagtgttgcaagctatcaagaaatggagtgacgaacaagaagattaattacgcttgaacaatctgtgatcttctctctctttctcttttgcttcctttttgctctgatatgaagccgaaagctgcagaaaaagaagaggcagggatgcaacaattgtaattaaaaatgttcgaggatagaatgagttgtagtagccaagaaagggtttagcgcataatcaggacaaaatttgttcagtgatgattcttggcaatttttactgctgctagaatgcaacaaacaaagacgcaagctaaaaaaaaaa

SEQ ID NO: 2320 - DNA, 911 bp, Eucalyptus sp.
gagacttcccctagctcatcttcactcaccaccaccaccgcccccgcccccgccgccgccgccgccgccgcaaccacctcatcctcctcctattcctccgccgtggcggtcgccgcgacaacagcaacaacctcctcctcctccacctcctcgaccgggtcggatccggcgctagaaccgagcaaaagaagcgaggattgcacttctcaaaagggcccggggaagtccccgagcccgggcgcccacccggaggagccggccggcaagaggcacaaggccgggggctccggcgagcacccgacgtaccgtggggtccgaatgcggaactggggcaagtgggtgtccgagatccgggagccgaggaagaagtcgagaatctggctcgggacgtaccccacggcggagatggccgcccgggcccacgacgtggcggcattggccataaagggcagctcggccgtcctcaacttccccgagctcgcgccggagctcccgcgcccggcctcgacttccccgaaggacatccaagaggccgccgcgaaggccgccgcgtctttcgcgccgctcccgtcggagcgcggagccgaggatgatggcacgggagccaacccgaggcgggacacttccgaaaggtcgttgtccgacacgaattcttcacaggagtcgacgaactgtagctcaaatgacaacgaagatgccttgttcgatctacctgatctgtgcgtggatcaaccgaacggcttcggattctgtccttccctctcgtggcaggtttgcgcggcggactcggggtctcggctcgaggagccgtacttggcatgggattacttctagttctagaccattgaagcgtatattcattttgtgctatagatcaatttgtttgctcgtaaaaaaaaaaaaaaaaaaaa

SEQ ID NO: 2321 - DNA, 1674 bp, Eucalyptus sp.
cttacagggcctgcttggtgggttaattctttttcagctgatatcgttgtccttacggttatcctcttctctccaactcctctggttctctgttccgccaaagaaatggggagacattcttgctgtgtgaagcagaagctgagaaaagggctatggtcgcccgaggaagacgagaagctcttcaactacatcacccgattcggcgtcggctgctggagctctgtaccgaagctcgccggtaagacatgatgacagacgggaaaggagaagctcattcacagttgttttctggggaataagttctgttcttggagagaatttgattcgaaaaccatgtgaatgatcgaattctctcgtcgaatgcaggactccagagatgtggaaagagttgcaggttgaggtggataaactacctgaggcctgacctcaagagggggatgttctctcaagaagaggaggatctcattgtcagtctccacaaagttcttgggaacaggtgggctcagattgcggcgcaattgcccggaagaactgataacgagataaagaacttctggaactcctgcttgaagaagaagctgatgaagcaaggcatcgacccggcgacgcaccaaccgatcagcgaggtccagctgatcaaagaagagaaatgcgccaagaacgagtccttgcaagtgccacaactcaagggactcaccccagccgtatcgagttccagagcgcacgagccggcattcttaatcagcgacacttgctatgagggcggagcactaatagaaccgtccagagagtccgtcgataataataactacatgagtaggccggttttcgattctttgccttactttgaattccagtctggggtcgacatggtcggctttaattccaatctgctgagccagtaccatgatcctcctagaaccatcgatcaaagccatcttgatattagttctaactttgagttttcctcgatgccgagcctgactaattttgaccaccctggtgcgacgatgagcgggtcggagttctcgaacaattccacttcgagaatgagtccattcttcttccatgaggcgaaagaccaatgctcaactaataatagctcgagcattggcaactacacggggtttcaggtgaacagctcggtcgaaaatgctgctttctcttggtgttctagtgagaacaagttggactgcttgttccagtaccaggccaatgggacaagcaagagtgaagaattgaaaccacaaggttcatggcaagaggaccagctacacatcggtcctgttaattcatcgtcggaagatttcggtagctttcagctgacatcgctttcggacgatctaaccgcagcgaatttcgacatctttcagcagatgtaaacttgtacatccggttcatcttatttgtcttttcccggttttgctctaatcacaaaagatacacacagatgtcgatatatacaggagatcatattcccgttgagagagtggaaaggagtttaattttttttcttttttcttttttttgggttggactaagtttccctttttcgtccgatgtttcggtacacggcaatacatcgcaacacgaatgttttaggaatgcagatcttgaatgatcatgatcccattttctttgctattgaaagaaataaggaaaccaaaaaaaaaa

SEQ ID NO: 2322 - DNA, 2045 bp, Eucalyptus sp.
cctcctcctccttctgactcctccgcggcaccgattctcggcgaaggagatggacgccccctctgctctcggcccccacgcccctcgccggagctccgacgccgccgacgatcggggccggaccggctgcctccgcaattccggccctcaggaccccggcggccgcggcgccaggtacaagctgatgtccccggcgaagctcccgatctccaggtcggcttgcgtcgcggtccctcccgggctgagcccgacgtcgtttctcgagtctccggttctcctttcgaacatgaaggtagtgccttcgccaacaaccggttcctttctagagaggcgaatgttgcatggttccgtcagctcaacaaccggtttgacaaacaatcatccctgccgtcccgatagatttggtgaaaaagaatcaggcatctttgagttccaaccctcaccaggaccaaatccgggtactgcagaagtgaatcagaaaaacaaagaatccatgcaagtccacagccactctcagactcaatcattggcattggtgccttttgtcaaaagtgaattggcagtcccatctagtgagttgagtctttcctcacctgctaaattggttccttctgtggctaatccgcctgatgaagttgattcagaggaatcaaaccagcaagatcacccaggtactggcatgcaggcaacacaatctgatcataaaggaaatgtcatggctgagagattaactgatgatggatacaactggcggaaatatggacaaaaacatgtgaaaggaagtgtgttcccacgtagttattacaaatgtacacatcctaactgtgaagtcaaaaagctttttgaacgctcccctgatggacatataactgagattatttacaaaggaacacatgatcatcccaaaccactaccaaaccggcgtgtcgctgggggtattatattgcatatccaaggagatagatctgctgatgtctcacctttaactggtgagacttcatcaaatgtctattgccaaacttccaacatcattgagccaaagagtactacacagctatatctggcagctgggaatgaggatagtgttgaaggcactgcttccttatcatataggattcgtgatgaggttgatgaagatgatcctttctcaaagagaagcttgctcaacaggaggttggacattggagggttagatgtcactcccgtgattaaacctatacgagaaccacgtgttgttgtccaaactcttagtgaggtggacatactggatgatggatatcgatggcgcaaatatggtcagaaggtggtgagaggcaatccgaatccacggtatgtgatggaactgcttgtcagatgttgattaatgcatctgtagttagcatctgctcatccagatgaccccatcatcatggacacgatacctggagctccgcatgcatacttttgatggagttactataagtgcaccaatgctgggtgtcctgttagaaaacatgtggagagagcatccaatgatcccaaagctgtcattacaacctatgaaggaaagcacaaccatgatgtgcctaccgcaagaacaagcagtcatgacatggcagcacccattgctccagccggaccttcaagaattggaccagaagaaagggaaacaattagccttgatcttggagttggaatcagctctgctgctgaagccaggttccccaacctgcagggttcgcgacataccatccatcagcagctggttcaaaaccaaatccactcgaacaattcgagtataaaggttctacgagcaaccccagtttcatcatattatcgtgttgaaaattgtggcgctaccacttattgtagtacaacagaagatttgagaggaggccgaggtttggatgtttcacctcgaaaccattcttattcatatcaacagaccgtgggaagagtaataactgggccatatgcttgttcaccccaaaaccagtctaaataagattctgtggcttttgttatattaccacataattaaagagctgttcgttttaaaaaaaaaa

SEQ ID NO: 2323 - DNA, 622 bp, Eucalyptus sp.
gtggttttttcagtttgtgctcctggtgtttccctcgagtggtttgagtctcttgtaaggctgtctcgttcttgctacctggttaatgctcttggctggttttgaggatgtgggtcttcgtgactctttgcctggctgattacctacaattcctaggatagcgaaacaagcacttttcccccctcgttcaacaggtcactttaagtttctcttctgggtggtagcatatggaaggagtttcaggaaatggggtggccaatcctcagctgctggatttgatgcctaataagagagaatggcatgtgatgattgatggagccaaagctcgtggttcttcagaagagaaaaagctggagctcaggctcggtccaccgggcactgatgactggtgcaacctaaaacaggacatgaacaacaagagaagggacgaggctctccttcccttcggccacttcccttccatggcctccacacaaatcgccaccaacaatggtggacaccaagcccgcaagtttggctcctcagaagctctggcatctccatggcctggtacaagttacaaagagaattgccaaaaactgcagaccaagaggagatgaagccacccaggccatattacccg

SEQ ID NO: 2324 - DNA, 2779 bp, Eucalyptus sp.
aacaacaaaaagctctcatcgatttcttcttcttcttcttcttcttcttctcgatcgccgccgatcttcgtgcttccgattcgactgaccgatcgtcggttcgttgctttcgccgttttcgctaaggttcgcttcgcttcgcttctctttccgacgcgctctctccgtatcaagtttctagcgaagtagcgacgaggaagaagttcccccccggttacggttagggttttccgttcttctttcgacgatgacgatgacgatgacgatctcccgctcgccgccggagggttttccaggaagtggttgcccgccgctgacgacggcgtttggtagtcgttcgcggcgattgttagggtttcttaatcccgaaggaatcgggggttttgttccgccttgaaggaggatcaggaaattaggtttgattactggaatttatgttgaaaaggctcggacgatgcgacatggttgtcgacatctactatctctacttccttttctagaattttattcgcttctgcttcttcttctgggtgaatttgatttggttggaaccgaaacgaaagacatgggaatcatgatggatggatggatggagatgtttatccattctcttataggtcgaacattgttcgtattgttggtgataagaggaatttaaatgcttgggattgctgactacagcggaccttggcttttctgcaaagggatcttcttgccaagaacgagttctgatgctttgagttaactttggataggtcgttcggtttggcgattgatagcatggctattaagacagcaaggagtactgtgggttggcaacaaaattcagctgctcactataaagcaccaacaagccgcagaagagtttgcacttactggttagcagggaaatgcaaccggaatccttgtaggttttcacacgatgcatctcttccgggcaatgtttaccatcgagctgcaaagcagtcgagtcatatggctgaggattgccctgggaggaagggccctgaatctagcccagtgaattcagcaagttcgacttctggagagagaagtgaatcgtcaacaaacaaaaaccctctgaagccccaagaaaaactatgcaatcactggataacaggcaactgcgtgaaaggagatgcatgtcctttcttgcattcatggtttcacggtgttgattttgctatgttggcaaagcttgagggccataaaaagggtgtttctgggatagcacttccttctggatctactaagctctactctggaagcaaagacggaacggctagaatctgggactgtcacactggtcaatgtgatcaggtgatcaaccttggaggagaagttgggtgttttacttgtgaaggtccttgggtgtttgttggcctgcctaatactgttaaggcatataatatccagaatggtgctagctacaatatcagtggaccagttggacaggttcatgctctggaagttgctaatgacatgctttttgctggagcccaggatggcactatcttggtgtggaaaggaggtagtgaggccgatccttttgagatggctgcgcctctcaggggtcacacgcagggcgtggtatcattaattgtcgggcgcaactggttgtattctggttccattgaccagaccataagggtgtgggacttgcacactctggagtgtgttcaggaacttgttggacacactgacatggtgatgtcacttctttgctgggaccagtacctgatatcctgttcattggataagacaattaaggtctggggggttgccactgaaggaggcagcttggaagttgtctatacacatcatgaggaccatgtatgttgcttgctaattttcttttttttttcgggggcactcgtgtggattagggtattttgtggttgatgatggtactttaggaaaaagtgtagattatagagggtgaaattgtgttttcttttattgtcctcatacgtgcgaagtgcatggacctgttttacaatctaagatcacaaagatgcgccttattgctttttggttttattcctgcagttaaaattaactatgtgaataatgtagactgaagctttgtaacatagccatactgtcaagtaccttccgtgtgcttgctctgtgcggggaagacatgaattttcatcttacacctgttggtgttttgtcagtttcttactgtgctagtctcatggaagtgatgtagatctgttgatgttgcaagtttcattttgtcttgcacagggtattcttgcactgtcaaggacaattgatgcacatggtaagccggtacttctctgtgcatgccttgacaacaccgttcggttgtacgagctcccatcgttcactggaaggggcaagatattctcaagacgagaagttaggactcttcaaacggctcccggaggcctattcttcacgggagacgctgcggggacattgaccgtttggaactggttggattctccaaagagccaaacagagcagcttcctcaatcgatggagtcatgctaagtagaagacagtcaagctattgacatcgaagttcaaatttcgcaaggaagacaacgtcatctatgccacgatgcgactgggattgtgatttagagcaagaaacgggacggctgtaactactaagtgtctgccccgcaatagtagtttttgggctgtcttctttgtatagacattgatttttttgacagcaacggctggacttgtatatgattcctcattagtaattgaaatgccctttgcttgtcgaaaaaaaaaa

SEQ ID NO: 2325 - DNA, 915 bp, Eucalyptus sp.
gaaaaatggggagagggaagattgagataaagaggattgagaatgcaaatagcaggcaagttacattctcgaaaaggcgttctgggttgctcaagaaggcgcaggagctctctatcctctgtgatgctgaggttgctgtcataatcttctcgaatactggcaagctttacgagttctccagttctggaatgaaacagatactatcaagatacaacaggtgtcaagattctccagagtccactgttgtagagtacaagccagagtctacgaaagaagatgataaggtggtagacaccctaaaagatgaaatcgcagagctgcagatgagacaactaaggctactgggcaaggacttgaatggcctgagcataaaggaattgcagcacctggaacagcaattgagtggggccttatcatctgtcaaggagaagaaggagcaatggcttctggagcagctggagcgttcaagattacagagggctatgctggagaatgaaactctgcgcagacaggtcgacgagcttagaggttttcttccatctacccatcaacttgaatataatccagaaaaaaggaggaaagccctcaacaactctggctctggcagtcctgataagacctgcaatcgcacagctgaaaacggagattctgacacaacattgtatctagggctgccatttgatgtgtaccacaaacggagcatgtctgacaaagagaactacaacagcaaagggaatcaaaagggcctgccgtgatatgcttttggcattgttttccttcattccgtaggaactatggcttcttagattggtgtcaacagttaatgagattgatgcatctttttagaaactaggaaaaagttaagatctcagctttactcctccctcatttattaaagggagacagacaatttcg

SEQ ID NO: 2326 - DNA, 1289 bp, Eucalyptus sp.
ctctttcactttctttcttctctagacttaacccctgcctctcctctgccctcggctttcaccattctctttttcctctgcataaaaaaaaaacaggggaatgcgcataaaaacccagagaaaaaatgcacagaatatgtagcgtggaatctgaaatcgctcttcgtcttcctctggccttgctttcttgcgtttagcctgcaatggaggtctcctctgataaacccaccagagaataaaaggtggggaaggaagaatcccgagggccagcaggaaaaaacccccctttttttctggtcctgttctatggcagcagcaacagagccgtcccaagaggtcttctcatggctcaagaatctgcctttggccccggagtaccaccccacgctcgccgaatttcaagatccgatagcttacattttcaagattgagaaggaagcctccaagtacggtatctgcaagattgtgccccctgtgccccccggcccgaagaaatccgccattaccaatctgaaccgctctctggctgctcgcgcctcgagctccgagcgtcctaattccaaatcctcacccacattcactacccggcagcagcagatcgggttctgccctcggaagccgtgccctgtcaagaagcccgtgtggcagagcggggagaactacactttcctagatttcgagaccaaggccaagagcttcgagagggtttacttgaggaaattttacaagaaggggtctccttcggctctcgaaatcgagaccctttactggaaggcggctgtggacaaacccttttccgtggagtatgcgaatgacatacccggttcggcttttccgccgatacgttcgaagaaggggagggagacaggggaaggtatgttgactgtcggggagaccaattggaacatgagaggggtctcgaggtcgaaagggtcgctgctgaggttcatgaaggaggagataccgggagtcacttcacctatggtttatgtggctatgatgtttagctggttcgcttggcatgtcgaggaccatgacttgcacagcctgaattacttgcacatgggggctgggaagacttggtatggtgtgccaagagatgctgcagttgcatttgaggaggttgtcagggttcaggggtacggaggagaggtcaatccacttagtgagtccatgtcctggcctaaatcttgagtatcccctgtttttgcatggctttacattttcacctgacgtttgtatggttgcttcactttctatcagttgtttggttgttgataaaaaaaaaa

SEQ ID NO: 2327 - DNA, 3086 bp, Eucalyptus sp.
aacaaccccgagagacccagcagaacagttgcttttgttcaaggaagggtgaccggacaaccagatctaacctcccttgtcgaagctttttccaatatcgaaggctttcctgagggtttctagcttcttcgttaacatgccagctggaatcatgattccggcaaggaacatgtcgtcatcgccgatgatcggatccaatggaaatgccagtgggtatggatcgtcttccgggctcaccctcggtcagccaaacatgatggaaagccttcatcatcatcagcttcaccaccccttagacatggttcatcagaccccgtcagagagcgaacttgctcggctccgagatgaagagttcgagattagcacaaagtcggggagcgaaaaccaggaaggtcaatctggagacgacatgcaggatcttcagcgtcccaataagaagaagcgataccatcgtcacacccagcatcagatccaagagatggaagctttttttaaggaatgtccgcatccagatgacaagcagaggaaggaactcagccgtcaattaggcttagagcctttgcaagtcaagttttggttccaaaacaagcgcactcaaatgaagacacagcacgagcgcggcgagaacacgcagctccgagcggagaatgacaagcttagggccgacaatatgaggtacagggaggcactaagtaatgccacatgtcccaactgtggagggccgacagccatcggagagatgtcattcgatgaacaccacttgagattggaaaatgcacgtctaagagaagagatcgatagaatttcagctatcgctgccaagtatgtgggcaagccagtggtgaactatcctcttctttccccttcggctccacctcgtccactcgacctcggagtcggaggttttgggggtcaatctagcgtaggaggagagatttatggagctggagaccttctcaagtcaattggcgccccgacagaagccgacaagccaatgatcattgagctggcggtcgcagccatggaggaattgatcaggatggcccagatgggagagcccctctggagtgagagcttggatggcaattcatcaggtgtgctaaatgaagatgagtacatgaaaacatttcctcggggtatcgggccaaagcctgctggatttaacaccgaagcttcacgagaaagtgctgttgtcattatggatcacatcaaccttgttgagattctcatggatgtggtaagggttctgttagttctcctcttgggtgctccaaatcgtgaggcgttcttgcttttgaccaggtattgatgcacagcgctgaaaaaatatggattcgttctcgaaatgatatctcgcatttactttttccgcagaatcaatggtcgacagttttctccagcattgtctcacgagctgcaacattggaagtactatcaacaggagtagctggcaactacaatggagctttgcaagtgatgacagctgaatttcaagttcctacaccacttgttccaactcgcgaagtctactttgttcggtactgtaaacagcacggtgatggggcttgggctgttgttgatgtttccttggacaatgtacgcccaagcccgattgtcaggtgccgaagaaggccttcaggatgtgtaattcaagaaatgccaaatggatattccaaggttacatgggttgagaatgtggaagtggatgatagaggagtccatagcttatacaagcagcttgttaattctggtcacgcccttggggctaaacggtgggtcgccaccttagatagacagtgtgaacgccttgccagtgccatggcaacaaatattcctaataccgatgtcggagtgataacgagtcaagaaggaagaaagagcatgctaaaactagccgagagaatggtgataagcttctgcgccggagtcagcgcatctacagctcacacatggacgacattatcagggacaggtgccgacgatgtgagggtcatgaccaggaaaagtatagacgatccgggtagaccccccggtatagtactgagtgctgcgacttctttctggcttccggtgctgccaaatagagtcttcgatttcctccgtgatgagaattctcgaagcgagtgggatattctctcgaacggaggggtggttcaagaaatggcgcatatcgcaaatggcagggacactggcaactgtgtatctctactacgagtaaatagtgctaactcaagccaaagcaacatgctgatcttgcaagagagttgcaccgactctgccggttctttcgtaatttacgctccggtggatatcgtcgctatgaatgtggtactgaacggtggggatccagattatgtcgcgcttcttccttcagggtttgcaatactgcctgatggttcggccatgcaaggtggcaatgatcaacagggagtgggatctggtggtgggtctctcctcacagtggcattccagattctggttgattcagttcctactgctaagctctctcttgggtcagttgcgactgttaacaatttgatcgcttgcactgtcgagaggatccgggcttcattatcgtgtgaaagtgcataactctgcagtctaatgtccaggggctgaattgcagtgctctgcagatgtaggacatcacagaagcaacgttaagaaagaactcgcagcttttgatgttcaagcagaaacatcagcttatatcgaatttggagaagtcaagatcgcaccttacttgcaagggttaaggggttcgggtattgacttcccaggaaaaagtgaaggcagggaaactaacacgaaacattacatttcctgagtttcgacttctcttttgaccaagttttgagaacttctgtagtttaagctttagcttagagcggtagtggtaaagttttcagttgcgtgatccatcaaaagttcctttgggttatttttttcttgatcctctctcaaagtaacccccccactgcaactgtcaatgatatgaacaatactggtccatttgttgttctcactttttctctctgatgtgctaatgtccaagcaaattctaatttggctcctgaaaaaaaaaa

SEQ ID NO: 2328 - DNA, 2299 bp, Eucalyptus sp.
cagaaggaaagctgccagaagctctatttgattcagaaggaatgatagacagtgaggattgatttgggtaatgctataacctgggatggtttcctggcagatattctgtgcaaagtgtggctcaaaagatttgactgctgacaatgatataattctgtgcgatggtgcttgtgatcgcgggtttcatcagtactgtctggaaccaccgttgcatgcagaagacgttcctcctgccgaccagggttggctatgccctgggtgtgattgtagagttgattgcatagacttgctgaatgaatcacaaggagcaaatctttctattgctgacagctgggagaaagtttttcctgaggttgcaacagctgataagactgaggacccaaacttaggtctcccttctgacgactcagatgatgctgattatgacccagatgcgcctcaggttgatgaagatctgggagatgactctagttctgaagatcagggaaatgactctagttctgatgaatctggatgtaatgttgcatctgataaatcgggggcttctttgaaatatgatcgcatcggtttgtcttctgatgattcggaagatgatgattttgatcctgatgctccggacagtgagaaggttaaggaggaaggttctagttctgatttcacctctgattctgaggatcttgcagccgctgttggaggtgtagcagatgaggttaattcctacagaggtggtggcagaagaagctctagaaacagttttgaaaagaaggaaattgtgaagggtgaactgcaatctttgctggagggagatgctgacaaagatgtctctgtctgtatgcctgggaaaagacatgttgagcgtctggactacaaaaagctctatgatgaggaatttggaggtaaatcttccgattcaagtgatgatgaagattggagtgataccgctgaaccaagtaaaagaaagagaggtgctgataaagtcgctttggcatcaaacaatggaaattttaccagtggagaaattatagagcacaacaaaaatgggaatgaacagactccaaggaggaggacaaataacaggatggattccccaagtactaatagtattacagccataccacgaagaagctcttcagcacctgaatcgactggtagaaaagctcgatcaacttatagaagacttggagaagctgtaactcagagactccatgaagccttcaaggaaaatcaatatccagaacgagctgcatcagagaagttagctggggagctaggaattactactcagcaggtgaaaaagtggttcgagaatgctcgttggagctttaaccacccaagtggtagtaaagtgagagtgtctgctaaagatatgataatggagaaccccaggcctcaactcagtactggaccacatagctcagctccagaaatgattacggacgatgcccctagcaatggaataccaaatgccgaacctagtggagttgcttccatgcctgagtgcatcgacaaggatgtgaagaatagcggagtgggtggtccacagatgaataggaaaagctacgatagttcacatcttggaaagagaaaggaaaaggcagataatgtggtctttggtccggatcaagtaaatcaaacacaggcccttcaagatgattcagctaaagcttcagagcctcagactagcagcagaagacacacaagaagcaaatcaaaaacctgacaatttcaaactttttgagcctctgaagagttcttccggttgagaaatactgggaaagataccctgttcaagaatcctgcatgcaaagatgactttttccaagaggggtaattccaactttctcttggttttccggttcaggattcagaatagctacttcagtcaccattaaccgttgtctcaggagtccttgggttttctgatcctgaatcctttgaccgtcattgtctgagctgctgattttcatcgtggcaatgctttgttcaatgggtggataaagcaagatagcggccaactgacgttttctttgaggattttatcggttcaattaccccattgtaggcgcctgcttttttcttgctagaagatgaaattccataggtggataccgcatatctgatgtacaaccagggagagctgccgaagagtcttggaccgagaagaatctgtccttgatgatgagcttgtaacatagcgatgccgcttaacattacattgtacttcatggaccacctaagaattttacatctattgcattcaatttatgccgtttttccattctttaaaaaaaaaaaaaaa

SEQ ID NO: 2329 - DNA, 1275 bp, Eucalyptus sp.
agacatctttgtgggagttgtgcatctaaatcagatatgcctgatttgtatgcaaaaattattcctgttttccagtttaagagtctttggagtagttacaataggttgaatgatttgtaccattttttggcaattggatgttaaaatatttgaatatgctcatgctttcctccctttatttttctggggtggaaagatgttggcattcattctgaagtatctctgaacttgagatgagtctgctggtggaggcatagacacagcatatctccattttaatggctaatagtcccttccttctctctgtcattccctttctttttctctttcatataggagttgggcctgagttgtccaagtcacaagatgaggatgctggcggactagtcggaataccttcattaccagccatgccaaagaaatctgggatacctgtgaggtcgacaacaagcggatcatcaagagacttatcagacgatgatgaaattggagaaactgcaactactgaccatttgggtcctcttgatgcaaagcgcgtgaggaggatgctttccaaccgagagtctgccagacgctcgagaagaagaaaacaagctcatttgagtgagcttgagacacaggttgctcaattaagagttgagaattctactttactgaaacgtctctcagacataagccagaagtacaatgtagcagctgttgacaacagagttttgaaagctgatgtcgaaaccttgagagcaaaggtgaagatggctgaagagacggttaaaagagtaaccggactgaacccaatgctgcatgtgatgtccgacatgtcttctgtgggtgtgccaccatttgatggtagtccttctgatacatcagcggatgctgcagttcctgtgcgagatgacccaaagcaccaattctatcaaaccaattctagtaaccccgcatcatctgctgacgatatgagaaccaacaatgggttggcagatattcctgcagctgaaaatgcgcagcagaatggagctgccaagatcggacgaacggcctctatgcagagagtggccagtttggagcacctgcagaagcgcattcgtggtgattcaagtcctcgtggccccccgtacgatggagaacagtagtagcaatagactagcgagaggatcgatcatttggtggatatttactaattcattaatcgaagcacaataatacagttcgctaatcgtatttgttcaattgttggtatatatacagttcgctaatcgtatttgttcaaaaaaaaaa

SEQ ID NO: 2330 - DNA, 1523 bp, Eucalyptus sp.
agacggccggcaaagcttcttcttcccctcccccatcgctctcgcggctctttccccacgtgatgaacacgccgtcgtcgttgccggagatgctccactgcgcggacatgacggtcctcgagcggcagcgcgctcgcgtgaagtggcagcaggacccgctccagcttcatgcgcagagcgaggggcagaggtattactacggcggtgggggcgagctgaacggcgcgtttggcttggggcagagcattgagagcttgttgggcggcggcggcggcggggtggtgttcggggatgtgccgaaccaccagattaagcccgacccgggtgtggaaagcgggtggctgagcagcttcgacttgtctggcttggcctatggggcgtgtgggttcggtggtgggactgggttggatgcgaatttcgccatcaacaggactttgagctgccctccggcggtggttgccgccgcggtctcgccggcggcgacgccggcggtgacggtggagaaaggtaaagagtcagcggtttcggagaagatgacccaagctgggcgagagagttccaagaagaggaaaacggataaagtgcacaacacaaagattgaagatgattccaaaggaaaaaggatcaaagggtgccctgaagagggagagtcaaagatcatggtgcagagcaacagcaacaacaacaaagaagcatctgcaagcacttcaaaggaaaactcaaaggtgtccgacgtcccaaagcccgattatatccacgtccgagcacgtcgtggtcaagccacagatagccacagcttagccgaaagagtgaggagggaaaagatcagcgagagaatgaagttccttcaagatttagtccctgggtgtaacaagataaccgggaaggccggaatgcttgatgagataattaactatgtccaatccctgcaaagacaagtagagttcttgtccatgaaactggctgctgtcaatccaagacttgaccttgaccttgacaacattttcgcgaaagagatgaatcctgcgtgcacagcaagctttccaacaattgacatgttgtcggatataacaaatccagcctaccttccttttagtccaacacaaacggtagcgtcatgctctggcatggaaataggaatcaatcctgactcggggctccgaaggacgataagcgcccccctgtcgatccctgacacgtttgtcgactcatcctgcttcagtcaatcacagcaacccttgacatgggatcttggtttgcagaatctttacaacatggagttccaccaaggaaaagcaatggcctttccatgtcaacagttcacaggttcagttgagggcggcaatctgaagatggagatgtgaaccaatatctcattgtcataactcctatgaattcattccaaattgctggaatccattttttttttctcctgtctatgtatagaaagatatatttgtacgtacatttacgctgatagtatgaataatagtagtctcaacctttccttgccaaaaaaaaaa

SEQ ID NO: 2331 - DNA, 1939 bp, Eucalyptus sp.
ggattcggggcgctcgctgtccctttggcgggaaaagaaaagcaggggctcgaatccatcttttccccggtgccgacctatccaccccctcggctatctcaccggccaacagcgtccctccacgtggggtccgcggtggagctgatctcggcgtgagcgtctctgatttcccgagcaccggcgcgctctccctgcgctggagagtacccgatcccttccgcctccttccctctccccgcgcggcctatagactataaagcagctcctcctgcgtcggttccagtttctccccgtctcctcctctctcttcgggcgccgaaccagcaagttcgagagacatggaaaaggacgcctcgcctcagtcggatcctaccatcaccacctcctccacttcgccggagcagccgccgccgccgcccccgccgcatgcgccccactcgccacctccggctcagtcctcgagctctccgctgaaccagcagttcgcggccaatttcagcgcgctgtaccactccattttcccgccaaactcccctcactcgagctccgcgctgattacgccgtctctgtgctcgtccgcttcctccgacagcaaccagaacgcgaccgccaggagcaccatcgccatagaacaccgcctcaaccaggctcgcctcgttctggagtaccagcagctgcgcgatcactacgatctctgccgcgctcacctcaacgacctgacggaggagatcgactcgctgcgccgagagaatgcgcggctccgcttggcgaactccgagctcgtgaagctccttaacctgccctcacagggcactctgcagagctgcttccgccgtctcggtctctctgatactaatgctacaggatcggatttctccagcgaagacgtctgcagttacagtccgacgagcgtcatggatcagagcggatatgagacgagtaatcccgagagagtttggctaccgaagagcatatcggttcggtccagtggctacctcaaattgaaccagcctgctgctagcaacagccgctcgagtcgaccggtgagtcaactccgctcgccaagagcacaggagcctccgaaggtgcaacagcgcgtgtacgtgccgggtgggaagaaagagcaggaggcattggagttcgaagtgtacagccaggggatgttcaagacggagctgtgcaacaagtggcaggagactggcgcgtgcccgtacggcgaccactgccagttcgcgcatggcatcgcggagctgcgtccggtgatcaggcacccacgttacaagactgaggtctgccggatggtccttgccggcgacatgtgtccctacggccacaggtgccacttccgccactccctcaccgagcaggagatgatgctggcttcgcgttgatcctgatgtcattgcattcattaatttctccattgatttggttatgtacataaaaagaaaaaaaaaaaactcccccaagaaattgatcaaacccacaaataacaactcaaaaaggataataaagatggtacaaagaggtaaatcaaaactaaatgcggttgttagtcggtttttttagtggagggaggaccatatccaggtggatatatagatgagattagcctgatgagatttaaggcgaaacttttcgattggattttgcttatgcgtatatcagctatcatgctaagacgtattggggccgtttctgttactgtgattttgcatgttgttgaccttatggttggttggggtacagggaccaacttaaccaaccataccaaaagtctgggggttttgtaatgatgacgcaatttgttacacacggagtacgttactttcagttcaagctagttatcccttgtccctctctcccctctctaaagttgttgccatcagtgagatgtgtatttgagaatattgttgattcgttagcaataaaaaaaaaa

SEQ ID NO: 2332 - DNA, 1700 bp, Pinus radiata
aaaaccaaactcagtgtcgatctcatcgatcagagtagaccacaagtatttctggtgtgaatcacatcggagatggcattcgcaggaacacagcagaagtgcaaggcatgcgagaagacggtgtacgtggtggatcagctcacagccgatggttcagtctttcacaaggcctgcttccgctgccatcattgcaatggcaccttaaagctcagcaactattcttcttttgaaggggtgctgtactgcaaacctcacttcgatcagctctttaagaggactggaagtcttgacaaaagttttgaaggaactcccaaagctgtgaaaaatgagaagttgaatgatggtgaggtacagtattactctatatctcttggcaagctctcaacctgcaatatcttatgatcatgtaggtatcaaagtataatacatctcttgtcagcttacagtgagaagttacaaggttgtgactatgtagacaggcatggagatgctgtactgtttttatcagcataaagaatgttgtaaaagacattcagagttggtacatatttctattcaaatatacatgtataacttataatcatgttattgttctgttcttagacaatatcgctttatagtcccgtcattataattgcaatttcattttgagggcagaacatattatcaacaacatttgcttggctgtccccttccaagtgtaaagggttctacatttggttattgaaagtgtgaagcgcagtaatgaaatctgcaagagcatctttatgattagatgtaaatctagatagtcacaaaatcagatttttagatagtctcaaaatcggatttctttaattcagaaggttgtttcctgctgtgcattaactgtttccatttataaataacttctggtatgtgcagattaagacacccaacagggtctctgctttgttttctggcacacaagagaaatgccttgcttgtggaaatacagtttatcccattgaaaaggtttctgtggaaggtgtgggataccacaaggcatgcttcaagtgtatgcatggtggttgtgttatcagtccctcgaactatattgcaattgagggcaggctttattgcaaacatcaccatgctcagctcttcaaagaaaagggcaattatagccaacttatcaaaactccatctgtcaaagaagtatcagagaattcagtacacgagtgattatgcagctgaagtttgacaaaattatctttggtgcaattatccccatttgtttgttagcaaggtgcaatgtacagtttaacatgactattggggacattggtcttttatttcagtgatatggtgtttcagcaaaactattttcaaattaccttttacaaatggttgttttgatctgtgagttggagtgtttcaatatttataatgcctatgggattggtacagctgagtattagactattagttgaggcgcatatactaagttgagtccatgcacggaagacgctgctgctgttaagtggctattagtggcagttaccgtaactcacttaatgctcctgtctatagcaatccgtgttatgttttaaaattgatgtgaaagtctggttgaggaagaaagaagcaggggttgtgctgatcacttgagaatatgttatatcgttcaatatttctcgaaaacattttctgaggtttgagatttgtattatttcaaggcc

SEQ ID NO: 2333 - DNA, 1126 bp, Pinus radiata
atcgggtctgggaactaccaacaaacattcgtagaccctgaaaattacacgaaatcccatcgaagctctccgacccggtttgataatccatacaatccgcgcacggtggaagaagtctttaaagacttcaagagccgcagaaatggattgataaaagccctcacaacagacgtggaggagttttatcagcaatgcgaccctgacaaggagaacttgtgcctttatggattcccaaatgaatcatgggaagttaatctccctgcggaggaggttccaccagagcttcctgagcctgcattgggaatcaattttgcaagggatgggatgcaagaaaaggattggttatctttggttgctgttcacagtgatgcatggctactttcagttgccttttattttggtgcacgatttggttttgataaaaatgacaggaggcgtcttttccacatgattaatgaccttccaacaatatttgagagtgttactgggattgggaaaaggccaacaaaagaaaaaccggctgttaccaacaacagtagtagtaaaaacaagcaaagtggaaagatgagagcatctgagcctccgatgaaaatgtcaaagacaccaccacctagggatgaagatgactcattggatgaagaggacgaagatgagcatggagaaacgttgtgtggagcttgtggagataactatgcctctgatgagttctggatctgttgtgatatgtgtgagagatggtttcatggtaaatgtgtgaagattactccagctagggctgaacatatcaagcagtacaaatgcccttcatgcaccaataaaaggccccggacctgaaaatgcacaaataatattttgaacaatggacatcctccgatggttttcaagcatggaggctgcagtccccaagtatttgtgtgcattttagcagcttaaaggatacacatgactttcctcaggctaatgctggtgaaacatatgaggagctgtagacagttttcatttttatattgttttaggtttttgtttacaattttaatgtaatactctttagtttctatcgtcctgtgtcgtactgttaattacatgcaaaaattgtgtaatatttctttgggctgatgttatgact

SEQ ID NO: 2334 - DNA, 3932 bp, Pinus radiata
cgactcaaagccttcacttgaaccctggtagggcactgggctctgtcaagccctggaattttaaggaacagattggtggttcaaaagttagggacgacccgggagctgtgaacagaaataggacatgtctaagcgggtgataattttgttaggaccgggattttatggtcttatctgaaactgagattgtttgaattgtttgaatcgttttttaatagtagaaaaaaattcaacaccctggaacagctaaatttctgaaatatgaagcagaagcacggatccaagggagggcagtgaaattacagtgattagttccttaaagccgtatataatccggttttatctgagcttgtacgcaggagcagtataactgaacggccattggagaagaaagcttaaagtcaagtgaacacgtggattcttctttgtgaaaacaagtgcgctatggagaccaacaactggaggaatgaggaatccaggaggaagatcgtcaatatgataacggacactcttcagagacacatgccacagacaggtgcagatggcatgaatgaactgaaaaaaattgctttgcggtttgaggagaagatttatacagttgctatgaatcagcaagactatctacggagaatatctctcaagatgctatcattagaatcaaaagttaatgaacattcaaatcactttccgggtagttctgctggtaacaaccagcagcctctagatcctggaggtatgatgttacggccacagactagaaatcagcaacaagctcctggaaatagtctcccattgaccgggcaacctgaaccacaacatccagtgctccaacaaaatcggcaaaatagcatatctgcaagtgcaatgccgaactcggctggtttagcacctcccttgtctccagttcctaatggtctgccaactatgcaaggaataccacataacttaatgaatagctcaacaggtcaatcaagcgaacagcagcgctggcagcatcaaatttttcaacatcagctgcaacaacagcaacatgctattctcaacaagcagcttcaacagcagtctcaaatacagccattgattcttcagcagcaacaatcagccttgccacagagtcagttccagccatcacagcagtatattctacaaccagctcaacaacctactctcccatcaactcaaccatctattctaagccaatctcagacctctattgtacaacctggtcaacaatctttccatcaatcaactcagcaatctgctctacaacaagcatctcagtcttcccttcagcagcatcagcattctatccttaggaagcagcaattacagcaatctgttatacaacagcaacagcagtctttaatggttcagcagtcaaatctacaaccacaacaacaacaccagcaacttttgggtcagcaaaatatgcaactccagcatcaaattcaacagcttttgcaatcaaagcatcagcaaacacaggagacatcatcatcctcattacaatcagaatcccagcagttgcaggaacagtcacagcagcagcagcttctctcccagctccaatctcagatccaaccatttcagcaacagcagcaactgttccagcaatcaaatccaatacagcaagagctgcgaaggcttcagacaactggtggcttgttgcagcaagcgagttctattgaagaacaaaggcagctattacaccagcgaggactgtcagaggactcttcaagttttccagcatcaacggaatcatcaggtcgaaaaggtcatccaactgtcgctgactggcaagagaatgtttatcagagactacaaaatctgaagaatatatattatccagatataaaagaattatctacaaagctttcaacgacatgtcagcagcctatgcaacctgatcaattagaaaagcttaagcactaccaaactactttgcaccgtatgatggcattttttgaagttcagaagagcagtattccaccagggtttaaagaagacaaggttgatgcttttgagaaacagattcaagctattctgaactcattttcaggtcaaaaaggtcatccaattgtcgctgactggcaagagaatgtttatcagagactacaaaatctgaagaatatatattatccagatataaaagaattatctacaaagctttcaacgaaatgtcagcagcctatgcaacctgatcaattagaaaagcttaagcactaccaaattactttgcaccgtatgatggcatattttgaagttcagaagagcagtattccaccagggtttaaagatgacaaggttgatgcttttgagaaacagattcaagctattctgaactcattttcaggtcaaaaagatcatccaactgtcgctgactggcaagagaatgtttatcagagactacaaaatctgaagaatatatattatccagatataaaagaattatctacaaagctttcaacgaaatgtcagcagcctatgcaaccggatcaattagaaaaccttaatcactaccaaactactttgcaccgtatgatggcatattttgaagttcagaagagcagtattccaccagggtttaaagaagacaaggttgatgcttttgagaaacagattcaaactattctgaactcgtttaggcagggaaaagctgctctacaacgacaacagtgacagcaacaacttccaagccaggctagcaatcatgtgcgatctatgcggcaacaagagacacatggtaatttttcaaacagatgaatttacaacctaacactgtgatatctattcagcacatctccgtatctctgttacagcaatctggtggacaaacatcacaacaaaatattcagactacgatgccatatgcggccaatttaaatttatcacgaggaacttgtgtaactaccttgcagcagagttcagtaaaccgtctttaacataataataatgttaattcttttcagcaaaataatgcttctctttagctgaatagtattgtctcctttcaccatagtgggatcaatcctcagcaaagtttgttcaatcctctacaacaaaataatataaatgctctgcaacgacattaccaccaagctctaaagcaggaagaagtgatgccagcccaggcacagcaccttacgatacatcagcagcagcaattttaacatcacttattgcaacgtcagcagcattttcaacagcagttacggcaacagcagaagcagcatcaagctgctcagttgcacgcacagtttcgggaacaacaaatgccacaacttcagcaaattaaagagttgagtattaaatcaaagacaaagcagtctgctgttaaataaccatttatacagcaataccatcagtaatgtcagcgttcagtttatcaacagcagcagcagattaagacaaggtcagcgctttaagtgtacacttctccttgggttgccttgtggaaggatggagctgtcgagggagaaatgtggggatagattctttggtcgatgtgtagagtagctagagactcatgggggcagttggaacacctagagtcacaaggctttgagactctttggttgctccatgttggagccctagaagggtagtggcacaacttgacggactactggtgcagagacggggtgcactatgtttgattgtgtaggctgatgagggacaagagattgtaggatggaggctattggagtttagttccttagtggtgctatctatggaccttagtcggctttaggaagtttttttccctagtggagtcactgccttagctcaagggtgacccactgctaagagattatcagtattgtggtctatggttgggaggaaattcttatgttttgctttgtttactttgtgtatttacatgtatcgtttttggttaatgtaactatgtgtattatgctttaaaaaaaaaa

SEQ ID NO: 2335 - DNA, 1940 bp, Pinus radiata
cttgaattgaccattttggtctgctcaaattcataaatggagatccatagaagcagagattagtacgccacacgcagactctgatcatggcagaaagcgaggagtgcaatgggggatatgagtctctcctggattggttggacattggtgatgagagctcatcaatggatccattcattaatggggacagctgccctattgcagaccaagagcatgaggatttctgggaagctgcgctgcctaccatggacatccagtctgaaacccagttcgttatggaaccatctttcagcagcaatgattcggttgccccagctgctcaaaagggcgatgcagagagcttttgggtagaacctcccgtgaatgatgtggaggattctcccaagataaccaaaaagagaaaaagagctagagtctcaggtgaatctaccaaaggcaagctctggaatgtcttcgaaaataatgcagcctcaccccacacaggagagagtttggatcatggcaaccactgcctggccccagaaactaagttaagttctctgcatggagcagaatcagacaatcaattagatttggaggccacgcgaaacaacagcaacaataataacaacaacagtagcaacagcaacaacaaaggcagatcaggtggacgccagagtagtccacctaatcttcccaaggaatcgagatgggctgaacaacttctaaacccttgcgcagtagctatagccaacaataacattgttcgcattcaacatctcatatgggtcctccatgatcttgcatcaatctcaggtgatgcaaaccataggcttgcagcacatgggctgagagctttcactgccaagatcatgcatcctggcgcttctcttccttgctcggaattcctctctgcagatccgaagttgtttcacaaggctcttatcaagtttcatgaggtaagtccatggtatcagttgctgtacaccatagccaataaatatctactggaagcctttgaagaccagaacagtaaagctcttcatgtaatagacatcggtgtttctcatggaatacaatggcccacattcatggaggcattggccagaagaccagctgggcctcctagtctcctaaggctaactatcatagcagacactcttggggcacccttttccgctggccctccttccaatgacttccccaaccgtttgaagaggtatgcaaagactttgaaccttgacatggaagtcaatgtcattgcacaacccctagattccctcaccagggaagccctaggggtcaaagaagacgaggcattagcaatctgtggacaatttcgtcttcatcaactcttaggggagggcttggacaaaaatgaaggcaaagacaaccagttaacatcagtttcccctcgtgacaagttcatcaaattcataaaggacctaaatcccctggtgtttttcttgagtgataatgatatagaccattcatctcctgatttcatagaaagatttaagaactctgtagatcatctatggagattcttggactcaacaagcgtatgtttcaagggaagagagtgcgaggagaggcgtatggttgaagacgaggctgccatggggttagttaataatgtagcatatgatggtgcttctcgtgtggagagaaaccagaaccatttgaactgggccaatagagttagggaggagggatttgtatgtgaaatcccgagtgacaaaatagttgactgtgcaagagccatgcttcgtaaacatgattcaaattgggagatgcgtttggaggatgggtgtatttctctgtgttggaagagtcatcctgtcaccttttgctctttgtggaagccatgttttaacgagcctacatgagcagactccttgtttcactcctattctgcaaatgctatgcatctttttcatcattagcttctaaaaaaaaaa

SEQ ID NO: 2336 - DNA, 1330 bp, Pinus radiata
gcatggctgcgaccagagctgaagaccgggaggagaatgggctgaatagtctcagggagggttttaaattgaatgagtaggtttttctggggtgagattctttcatatttatgcgtaaaacgttgactccaatcggcgtgaaacaaaccaatagaaatcccaaattgatttctttcaatttcatctgatacacagagagaattcagtcagtggaagtcatgtctaacataacgtctgcctctggagaggccagcgtttcttctggcaatacagctgccatggctgatagtgagagcattcggcaacagccaccacaacaattctcaacaccaacgtctgcaaatggcgccggaaatataaacagtgctcagcaaaacccagagaagaagagaaagagaaatcttccaggaactccagacccagatgcagaagtgattgctctgtcgcctaggactctcatggctaccaacagattcgtctgtgaggtctgcagcaaagggttccagcgagatcagaacctgcagcttcacaggcgagggcataacctgccatggaaactgaaacaaagaacgagctctgagatgaggaagagagtttacatatgcccagaacccacctgcgtgcaccatgatcccaccagggcgctgggagatctcactggcatcaagaagcatttctgcagaaagcatggggagaagaagtggaagtgcgacaggtgctccaaacgatacgctgttcagtccgactggaaggctcattccaagacctgtggcaccagggaatatagatgtgactgcgggactcttttttccaggagggacagctttatcacgcaccgagcattttgcgatgctttagccgaggatggcacgagaatgacagagggaataagcatactgcctcaagttgctccttcattgtctactgataaatccaatgtaccttcacctcatggccgagttccttcttatctctcagagggctctgtaagatctgggcatttcacttcagttcttgggccatgaggataagagcacccagcaagctgctaaccctattgaacagattcaccctgctggattcatttatggcaccaaaaccatgcagccaggtccagtggcgttggctggtcacgagttcgaatctcaactccggcgaaacgctcatgggtttccaatgccaatgtcgaccacaagcacaaactctggcagcatgtattctagtatttacagttcgcgtttccatggaataaattcaccaaattttggacgagatttgagcaattccgacagaaatacaagctacgacagtaccccatcaatgtcagcta

SEQ ID NO: 2337 - DNA, 1306 bp, Pinus radiata
atcgtttcttgttgggacacagaagaagggtgattgaattcattgattggccgggcggggtcctcatcctcgggagatcggatggtgatggattaaagtagcgggatctttaccccaatctcgaaggaggaaaccgaagattgttccttgctcgacacgcatcgatgctatggccttatatccctgcgcattactcaataacgtgcggccaggatttgaaaacgaaggtacagtcagtgcttttactcttgggtggtcgtgaaatacctccaggcctctcaggcatgcctattcatggccatcatcatcaaaaggttttggcagacattccacaacgtttgaatcaaccacaaagaattgcttcacttacgagattccgggaaaagcgtaaagaccgttgttttgacaagaagatccgctacagtgtgcggaaagaagttgctcttaggatgcaacgtaacaaaggtcaatttacatctacaaagtccaattctgaggatttgggttcatctgcagcaaagtgggatccctctcaaggttggcaccctgacagtaatggtaaccaacaagaagttgtatgccttcactgtggtattggagaaagatctactccaatgatgcgtcgtgggccagctggaccgaggtctctttgcaatgcttgtgggctgatgtgggcaaacaagggggtgctgagggatctttcaaaaaacccatcgtcgttggggagccagaatcaaccttcgagctcacatgaacagaatgatggaaggggagggagccatgaggtcgaggtgggtgacagaaatcatagtgtcactgttccaacgaatgagcatatttcatcatgacatctggtgcagaaatgcttgtttaaagacaagtaattatttgtcttcatctcagcagggtggtgactgtttagtgctttatgctctcaaacctttttaaatctaaatgtgtgtggaactgctgtatgaaattatccttcagaagggttagaataatttccacaaggggaagtaattgtaggaaatgggaaatggaggaggaattgtaggggctcattattttaggtattccccaagtcgaaaatggtaaagtcatgtaagagcactagtataatttatttataactgaaaacttgtatagggccccgaagtattcatacattaacaattctcgtatagggccctggtaaattgcattagctacaatcttcaaacatattgttggccctgcttcatgcacaggacatgtaaaataatagtattcaacaaataaagcagcattccatgtaaaaaaaaaa

SEQ ID NO: 2338 - DNA, 583 bp, Pinus radiata
tggagatcagaccgttgcctgcggcatcattaaggcagaagagctgggtacgtcaatgaagccaacaactctagatttcttgggcctcggaggctctcatggacgaacattatctcactcagactacgccatgatcacatcaatgagcaccacaggagctacaggcaacgaagtgcccgccccctcgccgtataccaaccacaacagtgtggagaataacaggaagcagcagcacagttcttcgccagcaaagtcttgggacagctcatagtcagaaataattgtacacagatggggcattaaacaaaaggtgggccaggttcctctgcaagcttgagaaaatggcagggatgacaacaaatgagaattcaagcctactaccctaccctagcctattttgccgggcatgtatattgtatccattcttgctcagaatcaaacaatatcttgtttggtaagttgttttttgctttaagctctcctcctgtaaatccaagccctcagttcaagggcacgagacgcatgaaaaactcttttaatatatatatttatacatcattcattctttctcccaaaaaaaaaa

SEQ ID NO: 2339 - DNA, 2319 bp, Pinus radiata
atcctgttctgctttcaatggaggcctgaggaggcgagctgagcaggaattactttccagcagggtcggagctccacagcagaaagctgggggagcactgccatttgcagtgtggctaggatggatgcgaggaacttgatatacttggtaatatggtaatcattagatcaattctactcgttcgcagtctgggcagctattattttggcagatcataattttttgtctatttcaaggatattgttatcagttcccaattgcctttaaacacattattctgagagacgtccaatatatgtaaaagggcatgtgagagagaccctttctatattggtcgttttttatatttcattgtagaaatactgtttgcaatggactaagttaagctactgaacttctattagctttgaaaattctaccatttgtacgttgggcaagttggcagtaactgaaagtgccgaagacatgttattttgacacgaatagtccagtgggttcgattatctgttttatttcaatgtggtattctgacctctccatgaaacacaattagaagaacagatcggttgatggtgttgggcgctagggcctttataacatgtgaaaatgtgagcggttccttgtcatgggcagtgagctgctgccgaaattgcattgaaaaaggagcggcagtagagacattgttttgattttcatatcttttccagtttgtttattcctttatctcctggaagttcgacaccatattgagtttgcaattgaaagaccacaatttctttaaaagtatttgaatagctttgaagatccagatggggaacagttctcagccacctggattctgctttcacccgacagatgaagaattgttcacccactatctgaaaagaaaagtatatgggcggcctcaaccttgcagtgtcatttcagaggccgatccatacgagtgcgaaccatgggatttgcctgacaactcatgcctgaaaggaagaaatttgaaagggtattttttcagccccaaaaaggcggaataccctattggatcaaggaaagttcgagcgaccaaactgggttactggaaggtcactcgaaaagaccgaactattgttgcatcctctgaagttctagggattaagaagactctagttttctacagagggcgtgttcgccatggagaaagaaccaattggcggatgcatgagtacattcttgatgattgcaacgatagcaattcaaatactatgcagcaatcatatgtactttgtaaagtctttcagaaaaacattagcagaagatgtaaacactgttctgcttcatcctctcaagtgaacaaaactgaataccctgatggagaacatggtgaaatggcttcgttgaatatacagaatgtcgctcaagctacaaatgacttcaaaacaccaaatggcatgcttctagggcagggttcagttctgaatgatgttcttgctcgtagagggcattcagaggtccctgataatgatgagtttcatatgttcttaatgacgcacattggtgatcctgatgatccccaactggataaggaagaaaatggaccaatggaacaagctgcttttgccaatcagcctcagcagtttgtagacacaaatctggaaaatgttacaagtggtgatgaacaaaaccctatgcaggatggcattaaggatgatgttgacaacttgcattttcaagataccatgataccggaggaagataaatcaaaattctgttcatcattatcagctcaacatgatttatctctcgatattttggatggagatttcatagagctgaatgatcttataactcctttagaggtggattcactcagttcagaatttgaatgacagccttcgagattttttattatgcctcaggctttataatttaatgggcgatttagcggatgggtgcacattgcggagaaatttgaagtcattcttataacagagtgaataatctggcatgtataatctttgatacatgcacattgccaaaggactaaaagtgggaaaattgaatgtttcttatgatgacctatttatgccttcatgaacaacagccaatgttcgtgattcccatagggtttgattaggtcagactgcaattttctatttataggatctttagatttaaagatcaattgacatctttgagctttaatggtatggctgctcgttggttaggataattggatgattttttaaatatgaaattaaactggattatagcagttatagcagcgttagttgctctcacttcagtgaatgggaaagagctaagagattactgttaaaaaaaaaa

SEQ ID NO: 2340 - DNA, 590 bp, Pinus radiata
agttttggatctgttgtgacatgtgtgagatatggttccatggtaaatgtgtgaagattacaccagcaagagcagaacatattaaccagtacaaatgcccgtcttgcagtagcagcactaaacgggcccgagtttgagactggcatacacagtactgtttttgtctgtattagtctgagactgatgtttcctggcatatacagtactgtttttgtctgtattagtctgagactgatgtttcctggcatatacagtactgtttttgtctgtattagtctgagactgatgtttccacatggccgcttcaggtgcgacgccatttattgtgattcacttgcaatcagaaggctgtaaatttggtttgatgcaggttgggaaatttgcccccgggaatgctgtatgcagcatatgtataaatattcagttagctgtttttattttttatttttaggactgattcagtttcagaagattttgatctaaatcagcaaaattcgtttagcagactctgctgaaaatgtaggtatgtgctgtgattacttacagcgtttttcctctttaaattggtaaaaagttccccaaaaaaaaaa

SEQ ID NO: 2341 - skipped

SEQ ID NO: 2342 - DNA, 1688 bp, Pinus radiata
gcttgagcaccctcgcggatttccagcgtgccctgccgattttggagttttggtttcagtcagcttcggcttcccgatcaccgtttttttttccctctacgttaaaaccacgatggacgagagtaataacgctcgtcggcaccaccaccacagcggaggaggcgcggctgaagtcgtcgccggcggcaatactggtggtggcggtggtgcaacaaacggcctgagtctttctttgcctctccctccgcccggttcctcctctgtcaagcttaacgcgtcaccacctcctccccctctccctccgcctcagaccgccggagagcccgcggggggggatcgtgtggcagcaggcgggggtagggacgatatctggagccagaccgccactctgactctgatcgatgcttggggagagcgttatctggagctgaaccgcgggaatctgaagcagaagcactggaaggaagtagcggaggccgtcaacggccggccgggcaataacaagcaagctaagacagacgtccagtgcaagaatcgcctggatacactgaaaaagaagtataaggtggagaggagcaagatcttctccggcagtgtcaccaaatggccgctctacaccaagatggacgaacttattggacccgctcgcaaacaccaccaccacccgcaaccgcttccactcccgcaaccgccgacgttgaggccacggcgccacctgatcgaatcttccccaaaccccctcaacacggccacttcccctgatatgaccgagagctgtctcaatggcttcaatgggaacccttcttcggccaaacgacgaaagacagcggcggcggcggtggagaatcctgatggcagcccgttgaaggagctggcgggcgccatcctgaagttcggggaggtgtacgaaaggacagaggtggtgaagcatcaacagatgatggatctggagaaacatcgcatggagttcgccaaggacttggaattgcagcgaatgcagttgttcgtgcaaacccaactggaactcgccaagatcaagcacgccaagcatggaaacacagagcattatctctaagcattccatgtcaaagagtccatttcatcgacaaccattcttggatagctccacggaaaaacaaatttggctcagacttggagcttttggaacagttgcaattgtagcttcaaaagctctggtgattgaatatattcaaggtgtcttgtgctaaatatttacatggatggttgtggccaattgcatgtactatctggcctgtctatgtgtactgttgaacgacaaaaagctttagcctttgagagttgcatgagccaaacaaatttacttggtcattgtcgattggcataattccaaatcaactttttcactgctgcccggcaagcttgtgaattgccttcatagcaaactcaactctgtattgtgtcctcagatttgatggccaagggatttgcctttagatgacttatctacgttggtaaaccttgcagccttgattctttccttccatgaagaatgctttacttctcaatgggatagcctgtagttactaagttggttgggaggactgtcttcatatccatatcatgatctaggcaaacttctgtactggaggattatttgtgaaaacggccgatgtaagtaacttggctttgctaaaaacatgtgatat

SEQ ID NO: 2343 - DNA, 1112 bp, Pinus radiata
gcacaacagaaatccaggcggagtcccaaggtgggcggcgacgaggaggatcaagaggatcgacagatcgcgattgtgccagtcgatctgatccaaaacaggcggccctttaagtgcgcctacagcggctgcgacaagactttcaagaatccgcagacactgaaaatgcatcacaagactcactacacggacgatgctgctgagaaacggctgggagaacagttcttgaataacagcacgccgggtaattgcagggcggggcataataagaagatcccctgcagatgccctgtttgcaggcgaacttttgtgggtttgtatgagctcagaaggcacttcggccggaaacattcagagggcgagaagatgtacggctgccggaaatgtggtaagcggttttatatcgaggttgatttgagagatcacgagaagctctgtggggagccgattgaatgtaaatgcggtatgaagtttgctttcaagtgtaatcttgttgcccataagaaaacccatgctgaatgccaggattcttcacactcaccaccaccacaaccaccgctacccaatgaagactcctgctcttcttcttcctcctcttcttacaaacagatccagtcacatccaacctcgttagccgttgctagcgtggcagcttttagtgaggacacatcatccgcgtcagcgtcatcaccatcaccatcatcatcatcctcagcagcagcctcatccgtggcattgatggtttcctgtggtgtcaaattggaggacatcagtggcttccctagagttatgactcctcgaactttgctaggccaagaacccagaaactagaaagtggacggattgcggcctggcctggcttggctggatgaaaacaggatttttatctatgttcctgctggtatgctcagtgctgttaacagaaaacagagttttttgttgtcgaatttgttgtattaaaggtagagcttgagtccatgttgtcatttcggcgctcgcattttctgtgtggagtttcaggaattgccgaagcgaagctctttgcaagcaatgtagttttttgttcttttttatggatcatggataccatcctgttcttctcaaaaaaaaaa

SEQ ID NO: 2344 - DNA, 2387 bp, Pinus radiata
agaagccaatgtagccccaaatattggacaaccgacaccattttttaagtaatgataaaaagcaattagatgggaagcacccgtaacaatgttatttgataaatggatttgtgtggaagactcatcatagattgatcgtatatatgttggatgtaattgtgtacgcaatcaaattttgtttggcatcaggagacttcctcggtcagcacgaaattcaatagaattgtcgtagttacgaagttggaatcgtttgtaacttagcagaggcggcagattatacccatttctctggtgttggtttgctgggatttgaacccatttgttttcgagctctgcgatagattcctgtctcgaactgttcggcacgttaatttggtaaggatcgaatcggtgtgaatttgggttgtggaaggatgcattatccaggaagcagctattatcaggcagagcaacccaacaataacaatccatcgtacaactgggcttcagcccctccttatggagaagcagcagcccctgcgtattacccccctgctcccgaacctgtggtagcccctacccatggttccgatccgtctaattatagctacaatttgccccagactatccctgccagttacccaaaccaatttcctcaatatccacctcccaatgcttcgcaattcaccccccaatcgcccataatttccccccctcctcctgccactaatgctaactatctctacagtagtagccctactgcccctgtttaccactccgctaccgctgcccaaaaccctgcttatgaccaagggttcgcctatcccgaccacagagggtatgaaacccgcgattcctttcagtaccctggttttgatcagaaatattatgaaacccctgttggaaaagatccaggttacgacaggagcggttttgatgttgacgatggtggttttggtggtgaagtttatgcctacgatggcggacgaaccgagccatatggggcccgtggcacaggtacaggttcaggttcaggtacaggtgcgggttcaaaacccctagcagcgtttgatgattatgggaatttgacaaagattacgaaggctgttccaaaggctgaaacgcaggatggaggaaacggtgtgcagaaattcagggtgaagatacttccagattcaggttctcagacaaacatggatgtgctttgccagattggtctggatggacttcggatgttggatccaagcaccaatagaactttaaaaatctatccgcttgagactattacaaaatgggaggtgaatgatccttcagtgtataatttctgggcaaaaagttcagttgatcttgagccaaggaggataaggttacaatcaaaccgctataccacaagtacaattcttgacactgtggctgctgcttgtgttcagcttcgagagatggttgatgacaaatctagtggaaataatagtgacacaaacaaaacatctgaccaactcacagagaaaaggagaagttcacttgcagactgggtgacattgaagagacctgtggaagaaaaacagcattgggtgcctgatgaagctgtgacaagttgtaaaggatgcgggacagattttggagcatttatccgaaggcatcattgtagaaactgtggtgatatattttgtgacaagtgtacacaaggaagagctgcacttactgcagacaaggatgctcaaccagttcgagtctgtgacagatgtttggcagaagttacacaaaggttgactagtacgaaggagacaagcagcaaagccacagcacaacggagtcatgatgatcttgcgaaaaggcttatggaggaaatggggagaaatcgcaagggaagctctgatattggtagtggttcatctccactttggtctagtcagtctacttccgatggaacgggtaaacggatgcgagaggttgcttgccctacttgcacggttcacttacaggttcaagtgccaagctccggaacagaaacggttgagtgtggtgtatgccaacacccttttcttgtcagtgcacgttgatatattggcagcagctgttatctaaatctgatcatacaccttcagtgtatgtaattttttggaatgcaataatgtcggtaatggcattactttatcgatttgattttttaattaatagcgcagtatttttgccacgaggaggcagaactttagaattttagtaacgtgttctggcttctgtaatgattatatttaaccataaaacgcaaagaatgcagtattaacgtgttctggcttctgtaataattatatttaaccataaaacgcaaagaatgcagtattattgtttgacgtgacctgttcgtatatcaagaaatacccgagcttttattgttgttaaaaaaaaaa

SEQ ID NO: 2345 - DNA, 1845 bp, Pinus radiata
gttcactactttagttttaaactttggtgtggtctcacaaatccaggtccccctatccattcatcaaaaaataaaaaatggatgttcagattactattcagtattatttgatagtagaactaattattttatttgggttgactggcagatggtcacttattgctggaaggttgccagggagaacagacaatgaagtaaagaactactggaatactcatttgagcaagaagcttacaatgagtagccaaaatcctatatttccaatgacggcacctgctgatccagagcagactgcatcatctgagtccagtgaagaagatgtagtgaggtcagctgattacagagtgattcatcactctggaatgagattagctcctgctaaaatcgggggtactagtatttcagcaggagtgcctgcaccggtttcctctgacgaagtcatcaacatgaaatcatggaagcaacttctagaagactcgttgatgagcgattttgatgactcagaggatgatacttcgttaatggggattgagctgagcgacgatgttcttggatcagaagccccattaatggagattcagactaatgtctcgtgttcgacctccggacctaatgaaccagtacattctcatgggcatttgctagccgatgccacttctaatcagaggtcatctgaatcaaatgttttgtattctcaggattgtaatgttctgtcattgcctccaactgacaatactctggattttaggatccaggatttctcgttagaaagtctgctcctgccttctgtttataatttcgatgagatctgtccagttcagagccagcttaatagcagtgatcacgtcagctgctttgcagtggctgctgaacaggcgatgacagacatctacaacaataccttggagccagattggttgacacctgtagaatacgaaaaacagtcgacccagtccgatcagatgaatttgttgggcaatttttttctttcagaagaaaactgggaggaagaagtaccgcctagcttgagcaaaatccaagaggaagaatacagagacattcttgtagatatatctaataagtagattagtaattttaacctcagcttggtgttctagcagttcatagtttgtaaagattgtaatgtattgtattaagtttatgatgggtatcataaacgttcagttcaaacccaataatcctgaagcgtctcagagcatataaattgccttgattaattgccttgattaatggccaaactttttagcatgtacattggaaatgaggccacattgttggaatgcccattgtcgtagtttgcctttattaatcgccaaacgttttagcatgtacattggaaatgaggccacattgttggaatgcccattgtcctggttttcatggctggatggatagattttattgacttttcatttggatgggtttgccacttttcatacaaagtactccactgtaatgggaaaccttagaaatagctgcatggaaaattgttctttgtacgacatcataaaaataggtccacgcagagcatttcaaaaaatacttgtaaaaatggccacacgattttttttagagcatttctcggagagtgtattgataaaatcccaacaaaagatttgatggaataaagtatatgaataattggaggtcgagcatagaggagaccacaatgaaaatctgttccacgttatttccctcaactaatgcctaccctcttggtatggtacgaaaaattgtccatgcttctaatatctacggaagcccaagaaagataataaagaatttccaatgtacaaacaaggaggagcatttttgaagtccaag

SEQ ID NO: 2346 - DNA, 3083 bp, Pinus radiata
ttttttttttattctattcgtttctgcattggggctctgtaattcctctcgggataagaatccccgatgcgggttttatcagttaaatttaatcctgcatgaatttcatctgcagcaaaatacagcgatgaattcaatatctgaaatgacgaccgtgcaaagtttgcagcattcaagtatgagcactgcaagcagcttcccttcggagagttcgggtggtttcgacgagaagagcggttttaaccagaaatctcgttttcccgaccgatttcctgctggattacgagttctcgttgttgatgacgatcccatttgtttaaagattattgagaaaatgcttcgcaggtgcctctatgaagttacaacatgttcccatgcaactgttgcattatcaatgctccgagaaagaaagggtagctttgacttggtcataagtgatgtttatatgcctgacatggatgggttcaagctccttgaacacgtagggctggagatggatcttcctgttatcatgatgtcagcagatggagaaaccagtgtagtaatgaaaggaatcaaacatggggcatgtgactacctcctcaagcctatacgaattgaagagctcaagaacatatggcagcatgtaatcagaaaaaaaaggaatttgggaagagaattggagcactcaggtagtgctgaagatagtgacaagaataagaagggttcagatgatattgagtatgcttcctcagtcaatgaagggacagagtctaattcaaaaacatcaaaaagaaggaaggaaacaaaggaagaggatgacgattttgagcaggagaatgatgatcctatgtctttgaagaaaccacgagtagtctggtctgtggagcttcatcaacaatttgttaactctgtaaatcagcttggaattgataaggctgttcccaagaggatacttgagatgatgaatgttcatggccttacaagggagaatgttgcaagccaccttcagaaatacagactttatcttagaaggctaagcgaagtagctcaacagcaaagtgggctaaactcttcctttggaggaactgcagaagtaaatttaggttccatgagtgcccttggaaggctcgacttacaagcatttgcagcatctggtcaaacatcaccacagactttagtggcaatgcaagcagaattcttgggaaaaataaatgcaaaaaatggtttgggaatatctggagagacattctgtttgccaaccgcattccacggtgtaaattctaattcgttaaacagcttagggtttgggcaacaattgatgaacaatcagggtggtgtactgcagggctttcctagtggtctcaaactgaagcaactgtctctgtctcagtcacaacctaatatctctccatatgagaatggcgtattttcaatgaatgatacatctccgggacttccatttttgccacagctctcaacagctgctgtggctctgagagatctggaccatatatatgggtcaaataacaatttaggattggatctacacgacaaggcattgatgttgaagttattacagcagcaacagctacatcagacacctggtccactgccacatcaatctggtgcacagctgcatggtcaacaagttctaaatctgccatcctccagtattttaggtcaacagacactttcgaatactttgtctaccctaggtaatgccaacagcaaccagggcaatagtcttattggtcctggttcagcacaaaagaatctcataacaccagaagggcatgatttaactctgcatgcatgtaatgcgtattttggaattcaaaggatggaagatgttaatcagagtcttaattctatgccagtaaacagtgtttttcagccaagaactgttgcatctaccccattgtcttctggagctgaaggtgtaatacgtttgccagggatgaacatccctagagagactccggaagtcttcaattcccagggtttaagaagttctggtgtaaattgcaatgcattgaatggctttgctcccggtttaactcagggtaatgtactgggttgtaaagttccaaaagctgctttcaatcaaggtttaggaccaatggtgatccctaccctaaatccacatttcagtcaaacttcctctggattgcagggcttgaatcctggaatacaagatcatgttctgagtcagagtcttggattttcaggaaggggatcaaatctccccaacagattcacatcaaatgatggacacctgaggacgatcagcaatacaccacgtcaaagtgatcagtctagagccgatactgggacaagattgaaggacagagtatcagacttgatggaggggactagacttgcagagggtgaattcagtctggatggctacaattgaacaattttcatgcgaaattaattggtgtgtgctttagtcaatttgaagcataaagttggtcttcaagctggaagagtgacatgactgccatgattatacaggttgtagattctaattctgaaatgagaattaggtgattcctttcttaagtagtccactgatctttgcttcagttcggaaaaattcttcagaagatgtcaatactaatgtatcagtgccttctttgttctcatattgccccaaggagcctcttaattatggtattcactgtacaggggtatcacttttttccgtgcttgagtctgattcagaaaaccaggtggaaatttcagggcttttacgtgaaaaggctagcttgaaattcaaggaccacaaattgtctatgtacagagtacactcatgtattttagatgtaatttatacgaggaaatatttatggccagatcttttgggaaagcatgggatctgtgtgcttctggaactgggctttgcatgtaataattatcagccgcggatacaatttagatttgttttgacctaagtgacttactgcaacagatggaatagaactgcagaaggtctttctgtacttgtatgcagcgaaaatggaatttaccacatctcaaattttcttatgtgacagacatcccatgtaaaattatggcttggtctgttaaaaaaaaaa

SEQ ID NO: 2347 - DNA, 1662 bp, Pinus radiata
ggttgatttcaaactacgaaaatggcaatgaacagcacacagcaatgtcaagaaccacaacaatatgcagaaatgagcttcctggatcgaatccggagccatttacttgaagatttagagggcctatatgaagaatcgtccctctgtgcgatgatgggaaatagcccgtttgataccagcagaaactcgagccctgaagtagagagcttcatccagagcgcactcgcaggcgattccgtcgacgacaacagaggggaaacggagacggagacggaaatgccgattccggccgttaagccctcgcgtccctccttatccgtctccattccccgacgtgaatctttcgactgggagaaattctctgtcggccgaggattcagaaatgtcgccagcgttacacctccgtgtgtcagcccttgcttatccgctgcctgggcgaagcttcctttaaatgaaaacgattcggaggacatggttctgtacgggatgctcaaagaggccgccaacaatggatggatgcctgtaacgcccaaggaggagacggcgatggaaacgaagaaggaagccgaagtttttcccgtcaagaaagaggccgaagtctttcccgtcaagaaaagaggccgatgtccgtcaagaaacgcgaacacagcagccggtggcgaagaagaagaacgtgggcggcattacaggggcgtcggcagagaccgtgggggaaattcgctgcggagataagggacctgcacggcaaggggctagagtttggctcggcaccttcaataccgcggaggaggcggcggtcgcctatgaccgtgccgcttacaagatgcggggttctaaggctttgcttaatttcccgctccaagttgcttcagggagcaataacacatgtagcagcgtagagaagccaaagagtaatggcgaagattttcttcaaaatcttaccaccaggaagagggaacgcagtgccggtgatgaagtcgactctggcagagaatgtcgggtgaaattggaagaatttacgagggagactgagatgatgtcgaaggatatggtggatgagcttttatgtgggaggatgacaacaccgccactcacaccgagtggaatcgacatgagcatctacaatttcctctgccctggacaacttatggtgaactgaggttgtcccttctttggtgtatatacttctctaccatttacaattatttcattttttttaaatcccttctgttcatcttgatcttgatgccctccacggtatggaatccatgctccacaaatggattttgtttcagtactctactaaagaaaataatacagaaatcctgtgaaaaaaggatctgtaatcaatggctagatttattagcctattatgaattttcagtatacaagcgccgaaataaggagtgcacaggagattcagcaaattgtggaagaggcagtgagaaggaaatgtaaatttgtaattcgagagagtctgttcgtttgccatcggatgtaattcacctggtttcagtttgttccgtcaaagccaactcttatgacagaacatttatgtgtagatgtaattcacctggtttcagtttgttccgtcaaagccaactcttatgacagaacatttatgtgtaacacataaactcaaccctttatttaaaaaaaaaa

SEQ ID NO: 2348 - DNA, 2593 bp, Pinus radiata
cttccttccatttgcctattgttttccttcgctcacaaggaaacggatttttttggtttattttttaacccaatttggtgtaatggagagaccaatgaccttcttggcttccaatccccagttaccccctggcttcagattccaccccacagatgaagagctcatccttcactatttgaagaaaaaggcctcgtcttccccacttcctgtgcctatagttgctgagattgatctctacaagtttgacccctgggagttgcctggtagtttaatctagattcagttgtcctgttatcatatcttggctatgtgggcatttctgttgtgttctaattggctctgtgattttatatttgtttcagggaaggcatcgtttggggaacgagaatggtattttttcagccccagagaccgaaagtatcctaatggggctcgtcctaacagggctgctggttctgggtactggaaggccactggaacagacaagccaattgtgatctctgaatcaaccacaatacctgttggggtgaagaaagctctggtgttttacagaggaaggccccctaagggtatcaagactagctggattatgcatgagtacaggcttactgacagtggaacatcaaccactggccataggaaaggatccatgagggtaagccactaagttcttacattaatctaccagatctatggatggagtgaaatgaacattttgttgtttttagaactggtgaataagagtctaaggattacctcagattgatggtagatatatggaatggtatcttggacttttggcataggctgtgcaattataacatctttttgtatatatctacattgaactcacaaatccattcatggatgtggtcatatttggagtttaatgtgaaggagatgagcatcttccaggtcaacaaccaactctatattaaagaaatctgatagggtggtgacgccatctagtttttagaagaaaaagaaagagtggtatatgaatggagaatattatattagttaactcaatattattggacaagttgttcaatttgctatacattagatttagtttgtatttcaatcctttcaatttattaggggaatagtttgtatatcataattttttattaatttaattgattataaaataatatatttatctatattattttataattatgtaatttcctaaaatttgttttcagtcactcaacctctttagttttcattaatttttttatttatttacagatgaatcaagatgatctcatagttatatgaaagtttacatagatccatgttaatgcagccaaaacatcatttaaattgcagttttatatttgatatgtaatagtttcataatgttttatgaatgaaagatttaaatgaacgtatttgaatagtgtgctaggatattttatcctttagtaatagtttcataatttctttccagcagcaaatgacaaatccagattattctgactcacttgtcttgcctgtctgtgcattcagttggatgactgggttctgtgccgaatctacaagaagaagaataccaaccctagactagcagcagcaaaagagagggacgagcctgaaacggaggatgtattggccactttacctgacatagaacaagatcagaagcctgtcatccccaaggttgcatccttcactggactactggatggggaatatccattcttatcttgtttcttgacagacaattcagattgcactggactggcaggtctaccagagttggaatccttccacaacaacagccacaacaacagcaaaagggaggaatacatgaacaacaacagcaacaacacacctaaacaacaaagctccacatcattatcatccatagacagcaaagttctggattctctaaagagaaccctttccttgggatgcatggaggatgaacctgcccctgcaaagaggcccaacatcaacaactacaacaacatgccattctttgttaatgcctttcaaccgaaccagacatattatcaatacccacagaagctcatgttcaatcccatggaagatttttaatcctttgcagagaccttgatgaaacttgtcacaacttatcaagctgtgaaacataccatgaatcctcattacttgcaaggagccaacagtactaccaattatactaagcatgtacagaagcattcatacttcccaatagtacccaggattttttaagctcttcaataggtctctttttcattttcccgtttgttgcaccaagcttaatcagtgtcataggtagtatgtaaaccatggtggtaaactatccatattagcataaagtctgtaacaggtcagtatgttcatataatttgttcactgggtcctggcatttgtaaagcatactgcagacattatggcttcataaggtctgggagtaaatttacagagtgcagtgcatcagttaaggagtattagcattgggaggcaggagtacaaccctgcaacaacaaagcagggacaccaaatttttgtatcaatctcatagccttatggtctaaacatataaagattcaatggaacatttgcgctttcaaaaaaaaaa

SEQ ID NO: 2349 - DNA, 2454 bp, Pinus radiata
gttctgcttctcttgcttcccgcatacgatcgagtcccgccgctgcgctgccaggctccgggactgtgaaacttctttttgttctttcagttctttaaatttaaagcatgggccgtgcaccgtgctgcgacaaagctggagtgaagagaggcccctggactcccgaagaagacaagaagctgctggcatacatcgagcaacacggccttggcaactggagatccgttccagtcaatgcaggtagcgacttctgtgcatagatctgtgttagcattcaattccctgtaacagaaggatgtttcacaaatttgctcgtggggctttattttgttgtattgcaggtctgcaacggtgtggaaaaagctgccgcttgcggtggacgaattatctcagaccggacatcaagagaggaaaattcagtctgcaagaagagcagaccattatccagctgcacgctctcttgggaaacaggtgagagcggacatcaatggcaaagatcccttcttcttggatctaatgctcagaaatcttgactatttttcagaaatcttgactataacaaaggcaaattaggttttctttaacaaaacttcttctgagcagaattgattgagtttatatgaaattttggttccggcaggcagaaagaatgatccaacaaatattgcacgttcattttgataaagaaaaaattgatttacccggtctgacttgcttccttacgttgcataaaccgggttgcattttatagagtataaatttattttactggattgctttaaagggattcttttaatgattatctttgtgttcagagcgcgtaaaaattaactatccctggataactatgccttgaatcaagaattttaaattgatttgtaaatttgcaaggatttcaggcatggatttttcattttcagtatgagtttcagagaagcttttaaattttttcaagtagtgtacttttgaaaatcctgtctataaagttggaaaattctttaaaattttgttaaaatggcgtagtgaatggttttttccccaaaatttcagatcaattttgcaaatttacaaggtttcgagtaaggaattctcactttaatattcaaagcaagaaattttggaagatctttttcttggaggagtgcgttctgtgataaggcaggaatctttgattgtaatggtccagacaagatttcggaaaaaatgctcaaagctcgtcttttctgataaagatctcgacaattaaacaatcgcttaatcagttcgacaagatttcgaaaaatgttcaaagctcaaagctcgccttctctgataaagatctccacaattaaacaatcgtttacttttatttgatacgaatattccataatcgcggtagcaaatgaatggattaagatgcaaacaattatttaattctgtttaaaatacagtactgtgattttatgtgcaggtggtccaccatcgctactcatctcccaaagagaacagacaacgagataaagaattactggaacacgcatctaaggaagcgcttgctgaaaatgggaatcgatcccgtgacccacaagtccacattcgaccctctgaatttgaacgacggtcagaagtcgaaggagttcagggccctgagccacaagaaacagtgggagaacgcccggttagaagccgaagcccgccaccgggagacgaatcttaaccctagagcttccaggggtttatggatgacgggcaacaacaatggctcagacgtgcttaacatgataatgttacacggtaataacaccagaagcaccatgagtagtgcttcgactaataattcctctcacattgatcacctgatcgagtctcctacgtcgtctttgagcttcgtcgagtcctcagatatgctccctctgtttcaccattcgattcccctcagtcaccaagaatccttctgtgagtatctacagaagaagcctttgtgcgagcacttcactggaatcgacatcaacaacgacaacaaaactgacgggggatcgaatctgggcgacccaaatctcctcattccatccagcttccatgatccgatattttcagacaaacactgcaattattctagcacgcactctatctccaatgaaatcagcagccatggcgatctgggttccgaaataagcagccatgtcgacctgaacactgatttgctccaacagtacttatctgaaggtccgagttgtgagcctgcagtatgttcagaactcgctccggaagaccaaagctccattgctaatcttggctctggaaaagattactggaacgacattcttaagatggtgaatagttcttccagtgttgacaacatcttttaattctaataatttactccattacatgtaattcttatgctaatgcttattttttaagtaaataaaagaattctcagccgtcacactatttatacctgcaaaaaaaaaa

SEQ ID NO: 2350 - DNA, 2544 bp, Pinus radiata
ctttgatagatttagagagcacaattggagattgttctcagggactgaccaggccggtgggttgctagcgtttcgtaatatgatgatgaatggtgcggggagattcgaacacaagaccaccacggggattgatctgtctgtgaaacttgaggaggatgatgatggtgggaggtctgtgcaggagaatggcagccatgggggagctgagaaggataatggttatgataatcgtactgctgagaaggatttcttccaccatgaagttggtcggctgagtttcaggctcttgcctgttgatggtgagagcaaagccgaggatggaactgcggacatgatgtcacaaggcccagaggatgaggatgataaacctgcaaccaatgtttcgactggattgaggttggttaatgtgcaagctgctcgaaacgctgcaagtgatcggtccaccgtagagatggaagattgtgcatctccgatcaattctcaggagacctcaaatcctaatgacatggatggtgaacccaatagcgagctggtcgtggttcaaaaggagctaaatcgtatgaacgaggaaaatcagagattgaggttcatgttgaaccagataaacagcagctacaacaatctgcagttgcagctagcttccctcatgaagcagcagcctcaaaattatggtcatgctgttagagagcaggtccataaagaagagaaattgaacatattcagaggaataacaggaaataataatggtgaagcagcagatgatcaaactcaaactccaattcagaggcaatttctggaaattaaagacctgtcgaggcttaattcaggcactattgctcatgaagactctcatacttctgaagctcgaaggaccctgacccatgcagaaaatgatcaggaggaatcaaaagcgttaatggcgttcaatcatattgataataagcgtgctcgggatcatgacagccatggattaacctcgaaaggccatgacagccctgatcgaacaccctctccgaatccttctcccactcatcatgaaaatgtaggaacccctcaaagggagggcagcctggaccgcagatcatctcccggatgggtgcccaacaagatgcagaagattgtggatcaaactgatgcaactataagaaaagcccgagtttcagtccgagctagaaccgagtcacccatgataagtgatggttgccaatggaggaaatatggacaaaagatggccaagggcaatccatgccccagagcttactacagatgcaccatgtcaccatgctgtccagtgcgcaagcaggtgcaacgcctggctgaagacagatcgattctgataacaacatatgagggcagccataaccacatgcttcctccagcagccacagccatggcatccactacagcagcagctgcctcaatgcttctgtccggttcttccacatcagctgataacatcgcactaaatgcaagcttcatggcaggtgccctcatgcagcatccttgcaacacatcaactgccagcatctcggcctcagctccattccccaccatcacactggatctcacacacaatcccaaccaaatggccaacgctccaggtcacatggcagcctcaaacccaagagcactagcaggactcccagctcatgccatgccctttgtaggcatgccacaccaattccccaccaacacaccccagggggcattattccatgggcaatcaatttacaatgctccttccatgtttgcacccttagcaggccagctgcaacgcccccaacaacccatgatgcccacaccaccaaagctcaatattcaagctggccaaccaccaacaccacaacaacaacaaccatcattcatagacacagtcagtgcagctacagctgccataacctctgatcccaatttcacagcagcccttgcagcagccatcacatcccttatcaacaacaacaacaatgctgccaatgccatttctaaacccaactcctctcaggcactcaatcctagtccccaggttgcagcccatgtcaagtcagatcacacccaatagctatgctagtggcaagattgtattcatgtggcatcactgtatcaattcctgaaagcattttgaagctggaagaaagtttgagtacaggaaaaaaagggagattgtgatttgcaaaagctctccaaggccttaaaatctttttgagaaattgaggttattgattgaggcattccagcacttgggccatggtgtattctaccactggtgaaatgtttgccaacggtggcgatcctctcaatccctttgagatctgggatatattcgtttttggaatttgaaacatttttgaaaattttcagttgtgtacaggcaacttgagtaggttttctttgtatagcttccttatcatacagatatatctatatatatatatcttcagcatcagcttgtgattccaaataatcagcccagtaaataatccaaaactgttaaccagcccataattatatatgaagaactagagtttttttgtcccaaaaaaaaaa

SEQ ID NO: 2351 - DNA, 904 bp, Pinus radiata
gaatcgatctgaatgagggtgccattgttattcgccagagaccttgatggacgttgcaggaggggcgagcaacagcatcaacatggaaatgtggaatatgttggagttgatccgccaccatttgctggaagtggaggacgatattgataatcaaggtacctcgccattctcgttctcctccacagccaatgctggcagcgtttatattaatattgacgatattgaaaatgaaggaacctcaccgttgataagaagagcagaggtgtttaaggtaaagcaacagccatgcgagcaggagaatggaaagatgaaacaaatcagttacaggcactacataggagtgaggcggcggccatggggaaaattcgcagcggaaatcagagatcccgtcaagaagggcgctcgagtttggctgggcactttcaacaccggcgaagaggccgctctcgcatatgaccgcgctgcctacagacttcgtggtgctaaggctttgctgaacttccccctcgccctcgcttccaattcagagagcgggttggccgtaggtcagagggcgcataggaggaagagaggaaacagtggcagtgggcgcgggatggacatcgaattggaggaaccgtcaagcaattttagctgaagccccctgactcatctccacccttagtctcggccgtgtgctgtgccagactgtgaagaaaagggatccataaaatgctttgattataattttacttatcataaattgcatggacaagatacatgtttcagttttgatttcaaatttaaggcgagattattgatagttgtacgtattgtgtttggaaaaccaacgacggaaatgtatttcgcaaaataggtttgaaataaaaactttacctggttttctattttatcaaaaaaaaaa

SEQ ID NO: 2352 - DNA, 1496 bp, Pinus radiata
agaagctatagatttcgctctgcatactctgagttctaggccattgtgtttagatcctatatcactagtagcagagtcaatgaatgtagttgaatcagttgccaggcaatcaagaatagagacaacccagagccctaaatcaaatcctagttcaacttccaatgttgtggatttctgcaagtttatgagaaagcctcattataactacgctgtggatatattcaatcccattgtaacagatcatgagttgtatcaggtgggttcaggcattgaacactgccaagacaacagtaatggtacagaaagtctgccatggccatgcccgagttttggagggctagaagacaatattaacgaacagcagtctgtgaattttcaagtggggaatcacggtgacctgaagcctatggctgtttcttgtcaactaacaccttctgagatccagtttcagcttatgaagggacaacaaggcgagattgagcagctccaatggttgacatctgttgtttcagccccaaaacagaaatcgggacaatggagggatgcaacggacagcctcggtctgaggccttggccgatgaaacatgcttgtaagcagggcctcaggctttgcagcaatcagcccactaagctctacagaggagtcaggcagaggcactgggggaaatgggtggcagagattagattacccagagaccgaaagagactctggcttggaacttttgagagggcagaggaggcagcactggcctatgacagggctgcttacaggctaagaggcgagcatgctcgcttgaattttccgggcttaaaacatcaacagcaattaaggcatggtagtcataatttatccccatcctctgcttctaatccgcattcaattacagcaattagcaatcaatctggacagttatctgttttgcaatctgcagtcgatgccaaactgcaagcaatctgtgaacgtttatctgcatccattaaaccatctcatgaaggaaagttgggccataactgtttggatcaaaagaacatcacagtgacacattgtaaggagaaatcagtccttgaggtgaaatcagaatgtcctgaattcagtgggggcgataacaattcagtgttaacagcacagaattctgattctgtgccgctttgtaaatctatgacagatgcagtctgcaatatgccatcgatctcagcttcggcttcggctgtggctacgatgtgggctgatatggatggcgtggatgctctaaacagaatgccttctttggacatggatatgacttgggatgtgctggaatctgaatagtcttttcagaccattaatggtcctgaatatatatttcttaataaagtagttacaaataagttgttccgactattcacaactcattcaaaaaagtaacgaaatggcaattgtacaacctgagattttgtaggtagtatattcatgtttattaatagaaagggagtcatattttttgtcaaaaaaaaaa

SEQ ID NO: 2353 - DNA, 907 bp, Pinus radiata
gttaagatggtgagatctccctgctgcgacaaggttcataccaataacaaaggcgcctggaccaaagaagaagacgagcgtctcatagcacacattgaagcccacggcgagggctcatggcgttctcttcccaaggccgcagggctgctgcgatgtgggaagagctgcaggttgcgatggataaactacctgcgtcctgatctgaaacgcggaagcttttcagaagaagaagacgatctcatcatcaaactccactccctcctcggcaacaagtggtcgcttattgcagggagattgccagggcgaacggacaacgaaataaagaattactggaacacgcacatgaaaaggaaattgttgagcaggggactcgacccccagtcccatcgtccccttggcctgccctgcaagactagtctcatctctcggcccgtccctgagcaggaaattcggacgtttcagagtcctgaaacggtggaggtagaagattttttccaaaatgaccgcccggtgagctcagccatcgagctggccgattccgacgcgaaagagcgccccgacctcaatcttgatttgcgtatttggcacttgcagtgaatctctcgtcccaattacagctggagggagaggccaaatttgcctaaaggactgaaagtttaaatctcacatttgaaacgtccagcatcagcgtccacaaagtagtttcatttccccctgaaagtttttcccgaaggaatccattaaaaattctttgatcctctgtaaatggtccaattatcgttggggactgcactgcaagcccatttttaatgtgcaggtggttaagagatcttttacgagggtcgtagttcgaggtctcattgacctttctgtaaaaatcgattgttcccaagatttaatacaattt

SEQ ID NO: 2354 - DNA, 511 bp, Pinus radiata
attcaaaatgggaaagaagttggagctgaaacgcatccaaaaccctaatagttcacgtgattccttctccaaatgcaagaggggactgctaaagaaatcggtcaagctctttgttctctgtgatgctgaagtttccctcatcattttatctgaaaccgccaagatttacgagtttgcaagcaacaagtcgtgactagctcttgtgaattcttctgatcaagttagagatccatatactgatatataaaagcatactttcacattgcaattggagcagatctagatgcagaagtgcaaccttattatacctaaaggccatcagctgcaaatcaagacccattttctatcttttgagatcgtgatacagagtctgaccttcttggtgagcgagaccctgatacttatgattgtgatgtggagtatacaactagctctgattcaattggagtacactgttgctacttgtggtgtttatggtttaagttgattgagttgataagtaaaaaaaaaa

SEQ ID NO: 2355 - DNA, 1033 bp, Pinus radiata
cgcgatgcccgtgctttgccagaggaagatcgcccaaaaaagggccgtcaatttaagggaatccgaatgcgaaaatgggggaaatgggtgtctgaaattcggatgccgaaatcccatgagaagatatggctgggatcctataataccgccgagcaagccgcccgtgcttacgacgccgctgtgtattgtctgagaggacccgccgccaaactcaattttccagaaaccgtgccgggtattccgtctgcgtcttccctttcccggcagcaaattcagcatgcagccaccagatatgccttgggtgaaatccctttgatttcgccctctctgcaaaatattgactcgagggagaagcccgcatcgtcgtcacgatcttcttgcaattcagaaacggatttgttgagcaacagtgagaagttttccaaggagctggacttcgatttgtgggaatctatgtttagcggccaagactgcttgagtttggaccaattgccgccaattgacgaagcgtcggcgttggagctcattccgccttggcagaagcagcagtagaagagtcggaatagcggtccatcttcctggaaccgacggagctgtggaagttccgagatatttgtattagaagagtccggaatagcggtgcatcctcctggaaccgacggagttgtggaagtttcgagatgtttgaattacttacagtgacgaggctgaaaggcacatccgtgttctgaaatcccaagtgggaccaaaatggccattttgtagcgttgttggccgtcagcagcgtggcgtcagtttagaacctgcgactgcgccatggcccactcgaagtcgggggcgggaaaggcccaggagggcgactgttcgaatcacaaaaacttgaatatgtttttgcggagttatctttaaagagacttttcgagacaactcccttttcgaatggttggttcgtattatttaacggccaaacgtcgtaatgttttgccccctttgatttttccattgttaatggtattttttttttaaaaaaaaa

SEQ ID NO: 2356 - DNA, 2956 bp, Pinus radiata
atcagatgggaaaggttccttccacaacggtgtctgaaggttctcttagtggagaatgatgactcaactcgacaagttgtcagtgctctcctccgtaattgcagttatgaaggttttatggctattcctcagagccttctttggcttaatgccagccatctgtaggtcttgtgaaatcccagaaaccttttctgggaggcagcatcattttctcgaagtcttctttggtttgctgccaactgtccgagggttgtgtgaatcccaaaaaccttttcttgcagtagtggctgttgcaaatggccagcaagcatggaaacttttggaagacccaagcaaccattttgacattgttttgacggaggtagtgatgccttatctctcaggcatcggtcttctatgcaagatcatgagtcgcagtaactctaagaatattcctgttataatgatgtcatcccatgattctatgggtactgtttttaaatgcctctcgaagggcgctgtagactttctcgttaaacctgttagaaagaatgagctaaagaatttatggcagcatgtctggaggaggtgtcaaagctcaagtgacagtggtggtgaaactgggtctcaatcacaaaaggatacgaggccaaacggcacagctgaccctgataacaacactggcagcaatgatgaaagtgatgacgcgagcattggcctgaataacagggatgggagcgacaatggcagtggtacccaagtttcatggaccaaacgagtggttgaggttgaaagcccccaacacaggactgaatggggtcttagtcagccacatagcagcgctgttggacaagttattcaacaaaaggttgagacagcccaaaatgggtggatgcagatggctgtaacttctggagaatgccaggacaaaaagccccttgattatgctatgggccaggacttggaaattgctgtgccaagacaaacagatgcagaacttgaacaccagcaagaggaaaaggctttgtatgctcaaacttttggcagggaggagaatgcacgtttggcgaacagcgtagagggcgttgaaattagcgagggacccgtggaaagtggcgatagtccttctagtgagggtgcagctaataaggctgctgacctgattggtgtcatagctaacaagcctaactgtgggaactccaaattggaggacaataaaagcggagaagatttagataatgataaaataggaactgatttcaaacatttatttcttgagctcactttaaagagaccccgtcaaaacggaaaagaggatggcgagcctgaagataggcatgttttgagacaatctggtgtttccgcattttcaaggtacaacacaggtggatgtcagttttctaatccctcaggcgataccgtgccgcctaattcactacccaaaggatacatcccttctgttagccttgaaagtgagaaaacagggccattacatgctgctgttggtgtcgagagagtggcttcctcaaaaggaagcgggggtcctgatcaatccacaccagcacttatgcacaatcagctatcgcagagtagcaacaaccaagatctgggttcttctgtggttggcccttctggacaagatatgtttccagtgcctaagccaatcagtgatgagacagtatcagttccaaatgcatgtcggcaggttggaaaacccatgtcgatacatccctgcagagcagtgccatatgatactgtagctgcccccagagtatatgggtctgcgatacatcctttatattattctcatactggtgcatcgtctctctggagtcccgaagcacaacacatagctgatagaggagacgtatgtaacaactctaataatggtcaaatcgaacagcaacttgtgcttccgcgaaatcatcagacccaggttcatcatcatcaccaccaccatgttcagcatgtccattaccacgaacatcatcaccagactcatcaacacaagcacaaccacacacacacccatgatcatcccaagcaagatgaacagaccaagaagaacttctccatcacacctccactatgtggatcatctaacatgcccggaaacgatgctccagatggtaacaatggccagagtggcagtaacaatggctacggaagtagtggaaatggtaacggcagtgccaacggaagcgcatctgggagtaacaatgggagtaatgggcagaatgggtatagtaatggacagaacagtgcagctgtcactcctgcaggaaccaatggggagagcgacactggcattggtgcggtgaaaagcagcactggaggagcaagtggaactggaagcgggagtggagttgacataaatcgatctgcccaacgggaagcggcgctgaccaagttccgccagaaaagaaaagagagatgcttcgaaaagaaggtccgatatcaaagtaggaaaaagcttgccgaacaacgaccaagggtgagaggccaatttgttcgtcaaacagcacatgaaactgcaaatggagaagtagattgattgggtggtgtttaaaactttcaccctttcagaagatttctccatagaagatttctccatagagctgggatatttttacgatttgcctctctgcggcttccttcatgtaaatggtaacatgtgaaagactggttcatcttgctatttcaagatttatcatgattctgtgggaccgggtaaaacttttgagaaaactgggtagaacttttgaggaacctcccttaaagaaacaaataattgtttatttagcggttctcaaatacacgatatcaacattcctccttgtggatgcggctcttgaaagtgtctgaagctagtgtggaatggaggttctgatttcgcctggacaagattctctctgtaattacacctcactggatctgttatgatctcttatgcagccatctttttgcaaaaaaaaaa

SEQ ID NO: 2357 - DNA, 2065 bp, Pinus radiata
ctaggttctgcaatggctactgctcgtgatttcttcccagattctggatcccatcatagcagcagccatggatcccagtcacagtcttggctgctggttgtgactgagtagctagtttaatggcctcacagttagtgttgtgccacaattcccatactcagagctctgagtgcagcttttttttctgtctgacctcttttagggtttcgatcaaaaatcgactgcaaattaaccagttggggactacataatcttgaaatgcaaaccggtagggcagaaaatcggtcatggaattcggatcagccgaaacctataaatttaatggcgccctcacaattagtacagggaccgcctgcctctgccttggctcgaaattctgcaggttttttcgattcactgggattgcccgggcaagaccagtttctcgatccttgttcaatgtggaggctggggtgtaatagtgaccatacagcccttcatgagcaactgcatggggtaatggagaagagtggtcagttcgcccatggctgctattttgtcaaggcagaggaggaattggactttttcccggccagaatgggacttaacctagctggggccggaacagctactgcatattccagcggtggttcccaagaaagtggccatggcaatagattttgcaggacgggaatctcctcgtgtgcaggctcgcagataccccattgccaggccgagggttgtaaggcaaacttgagcagtgccaaacactaccatcgccggcataaggtttgtgaattgcactcgaaggcttctactgttattgtgggtggtttcattcagcggttctgccaacaatgtagcagatttcatccaagatctgaattcgacgagggaaaacgaagctgcagaaagcgccttgctgaccacaacagacgaaggagaaaacctcagccaagtacatgtgttacatcacaatctcaggctgggacaacaggtttagaaaatgataaccagacaactaaaggatcatcaggtcacattacaacggctgttcagaatacaccgaacattagcagaagcactagtagtactagtccgtccttgattacatcagtaccgatgatgatgttcccaaataactataaaggacatagtcctgtcctcaaaggaacttccactgacaagaatagttgtgtagaatttctgtatgcaagcattgcgaaaacgggtgcagactcatcacgagaggggcgcataatctctgataaccaaatcgaatcgagcgaatacaagctagttcagccttgcagcagccagctgagacctggatttctagcttcagaaattgcaggacgtttctcaaggccggccccagtggacatccagtactctcagtctctcatctctatgaagaacaacaattccaacccacgtgttaccgagcccagtaaaagtttattgaatctgcgaatattttccactagttccaacgatgttccagcaactctgtcctccatgaagaacggcgcctcaaactggattttaaatggaagttcggctgaaagtgttggaacttacgataaaattcatgaaacagcagagtctccaagatcagcctatgatccagcaccaagaaatgatgcagtaataaaatgggatgaagtgtaaggccatgcatgcataacttcactttattatcaggagacaccattgcgttcaaaggggattcaaatgcagctatctttttcagatgttgttcaccctgagatgatgcggagtatgttggaagaactgaatggtgggttcaggtgagatgttttacatgcctttttacattaatgagattatgccaggattaatgtgcatgcaacgtattatgatcttataaagtattccaaggattacgatcttagtactttcattaatctagttaagggtattaatgagaccttgggttagggttaatcacaattatttcaagttaattgtgttgactgagtaacaccatgattgtttccatcaatttagtttggctcaattaaggcaattgatcatctatattgtttatgaattaaaaaaaaaa

SEQ ID NO: 2358 - DNA, 1671 bp, Pinus radiata
attgaaatatatgttcgccaacagactgacaagaggaaacttagagcctatggactgccgatgaaatgggagaagtacaagggtctcgaaattttgtaggttgcctggccaaagagctgatgtctaggatttttttcacccaaatgctggctgaatgctgtgaaataaattaaaggttttgaagaaagtgtttcatgaatatggagcgtctgaatacagcagctgcacaagcctcgtcttcgctttatggagttaacatggcagaatatggagatgctggcgtcagctcgatgatggggttgataacccaacatgagcctgagcaaagcgaaaatattatgtccacgaggatcccaagctcgttttcatcattccatggccatgccgattgccttctctcagcagcaatgtttcagggttctcaaggagatcataagctcaatccacagcctgggatgaaccagcagctagtctctgagcagtctatcatgtcagattcgtccatgccgtttgttagacaaagcttgctctggtctcgtaatcagtttgaatttcgcaggaacaaccggaatgctaacagatcagtcctcaaatattccgctaagcccatagtcacatcgttagcctcgcaggctcgaggagaagcgcggatgataccgtccttggatgccaacagtgctcatttcaatgtggataacgaggagcatgcaataaaatcgaaaatcttagcgcacccacagtatccgagcttgttgggagcttacatcgactgtcaaaagattggggctcctccagaagctgtggcccgtttggatgctctaactcgcgaacaccaagacccacaacgtcggactgtgagcatcggaatggacccagaactcgatcaatttatggaggcgtactgcgagatattgactaagtaccatgaagagcttgccaaacctttcaaagaagcaatgctgtttttgaagaagattgaaacccagttcaactccctgggaaaagaaacgataagaatttcttctccagctgacgatgacgaaaagacggagggaggtggatcttcggaggaggtcgaagacggcagtggtggtgaaacggattttcaggaagtggatcaccatgcagtagaggatagggagttaaaaaatcatctccttcgcaaatacagtggatatttgagtagtctaaaacaggaattcatgaagaagaaaaagaaaggaaagctccctaaagatgcacggcaaaagttacttgattggtggagtctgcacgacaagtggccttatccttcggaaacggagaaaatagctttggctgaatgcacggggttggatcaaaaacaaataaataattggtttataaaccaaagaaaacgccactggaagccttctgaagatatgcacttcatggtaatgaacagtcacagtcctcacagtgctgccttgtatgttgagagacatatgatgactgaagggtatctttagattgctagaaagaaccttcggctgaaaacagccctcaaattccaacgtgaatcaatctcgcagagaaatgcaccctcttgtcgacgtaccttcgcatcacattttgtgcttgttgttgggaggccatggtcggagattgggtggtgtgatgttttcgtttcgaggagcaatttcgaagaagtta

SEQ ID NO: 2359 - DNA, 2039 bp, Pinus radiata
tctcgagttttttttttgggtcgtgggcatcgtttcgaactgttgtctgattctgcagaatggccacagaagaagagagcggctctaaatgtcctaaggatttgcgccgttattgctgcaaaacttgtggaatcacaagatcaaagcgcattctgctcaagctccacataatctctagccacggaagagaagccctagaaaatgatgaaggatttgcttcagaggtgaaaggccagagtcataggcggtctgcatgcgtttgtcaagattgcggggcttcgtttaataaacctgctcatcttgaacagcacaagttatcgcatacaggccagtattcaagttattttctgcaggaggtttgtaacccaggttagtacaagggaggagactgccttggaagagctgggtgtttgaatgcgtgacagcacaggatcccatccgaactccacagtggtgagggagggcagagtatccatggattagtaccaggtggggtgaccccctgagaagttccttctgccttctactcgctcacgcttcatcattatcgtacatgtttgttgcaatcacagagaacttttgtttgcccagtagatggttgcttttgcagttacaagaggcaggaccatttgaatcgtcacatgataaagcatgaaggaaagttatttgtgtgccccaaagaggactgcaaactgcagttatcaactatgtctaatttgaaacggcatatggagcggcatagagagagaggtgagtcatggaagagtctgaatctacaatccagagaggtgaagaagtatccttgcccaaagccatgttgtgggaaggttttcaaaaatccatcaaggctagtaaggcacctagatgatgtgcattctacatcatatgtacaagttgtttgctgtgagcctggctgtttgaagtacttcacaaatgtaaaggctttgaaagaacacgtgcaacagaaccacagccgtgtttgttgtgaagtttgtggtagtcaacaattgaagaaacagatcaaaaggcacatgcgcattcatgaaagccaaacgtgtggggagaggataaagtgccacttcgacaattgcttgcatagttttactaaaaaatcaaatctcaataagcacatcagagcagtgcaccttggattaagaccatttaagtgtagatttcgtgaatgtgaaatgagtttcgcacataagtctgtgagagacaatcatgagaagacagggagacattgctatgtacaaggagatttcttggaggaggatgctgactttcagtcaaggccacgtggtggtcgaaagagaaaagcgtttacaatcaacacactcttgaaaaagagagtagcatgtccagatcgaagcagcactgttcttgacagtggatcatcctttttagattggttaatttcaagcggcagggaatgatccttgagacgatggaaaacgtagtacatggtaccatcgtctgatttcacctgtatgtttttttgcaccagattggagtggtaaaatgtagaacagcatttgaagtgcatgttacaagattcaaatgctattaaacatgtgttttaggggcatgatggccagattggatttcttatacggagttccttggttaccacgggcactagattgggggcgagggtgttattgaaggttttgtctataggtcatggcggtaatttctatttgaaaggggagcgaaggggttatttaagtgtgtctataggtctgctttggggccaaggtctgtgcagctgtattcaatatttaacatgatataatgtacatgttagtttcaagcaaatgtaacttgttacctcagagcagtgtattgtgatgaggacgtttcaagcaaatgtaacatgttacctcatagcacagtgtattgtgatgaggacgttacatatttaccatcactgtcacaaatacattcacattcgaatgttgaatgaaattcttttatactacatgtcagggtattaaaatactactaatgttgaatgaaattcttttatactaaaaaaaaaa

SEQ ID NO: 2360 - skipped

SEQ ID NO: 2361 - DNA, 2815 bp, Eucalyptus sp.; identical to SEQ ID NO: 41

SEQ ID NO: 2362 - DNA, 1172 bp, Eucalyptus sp.
tatctccctccctccctccctccctccctccctccttctctctctctctctctcttcccccacctcttttcttcttcatcctacagaaactgaacaatcaaaagtgagagagagtgttcagatccaaagcagttaagctgtctctcatatatcaatcccacctctctatcacacttcacttcacgcactgatcggtcaatcctatcaaccatcaaatcaaagcggaacaacatgtcctcctcatctgccttttcaccggaccccctctcccccaacgagcagctctgttatgtccattgcaacttttgcgacaccgtccttgcggaggaaatccggaacgtaccatcgaacatgctgatgaatcagacgatccccaacgagccgatgatgcagctacgaggagggatagaagatatcccgaagcccccaccggttgtgaacagacctcctgagaagagacagagagtcccttctgcatacaaccgcttcatcaaggacgagatccaacgcatcaaagctgggaatcctgatatcagccacagagaggccttcagtgctgctgcaaaaaattgggcccatttcccgcacatccatttcggacttatgcctgatcatcagcccgtgaagaaagctaacttgcgccaacaggaaggagaggacgttctcatgaaagatgggttcttcacgcctacaaatgtgggtgtctccccctattgataattggctaagtactttgaaaagaaaaaacagcgcccttgtgtgtgtgtgtgtgtgtgtgtctttctctttctaagttcatccgttcacttattttcttccttctacttccctcgtatgaaagtgtcactactagttagtctcttattgttctaagcttcgtttctaagagagacttctctaagctctatggctcttgctcagtttccatgccccttgcggtgtgtttgaagcttttagttggattgattaagatgagagagagagagagagagagagagagagagagagagagagagagagagagagagagagagggagggagggagaggtcttgaagcttgtacaacattgagcttcttgataccgaatcctagatgggtcaaggtttgttcatattcttaatatgttgtgaacctatcttaaccatgcctctctctctctcaaaaaaaaaa

SEQ ID NO: 2363 - DNA, 255 bp, Eucalyptus sp.
ctaagatctgccaattcaaagccacaggctcattggtcaccatccgcaactccagtcttcgagcaggcagggaacagcaggcatggaggtgggtcagatgcagaggaggttggtagagttcaccaaatcattgttcaggaagggtttcttggacggtcagtttttgcagctccaacagcttcaggacgagagcaaccctgattttgttgtggaagttgtgtccctcttctttcaggattctgagaagctgctcaa

SEQ ID NO: 2364 - DNA, 255 bp, Eucalyptus sp.
gccaattcaaaaccacaagctcattggtcaccatccgcaactccagtcttcgagcaggcagggaacaacaggcatggaggtgggtcagatgcagaggaggttggtagagttcaccaaatcattgttcatggagggtttcttggacggtcagtttttgcagctccaacagcttcaggacgagagcaaccctgattttgttgtggaagttgtgtccctcttctttcaggattctgagaagctgctcaatgatctgac

SEQ ID NO: 2365 - DNA, 2277 bp, Eucalyptus sp.
ctctagtctcgtcgatttttattgccgggagggtttgggattgtgttcagtactgtgtatgtcgttgaggggagagcgtcgcatactgaaagcaaaatttgtcgagatgcttctggtttctgttaagtaccgtgtaggtcttaagaagggaagaaatataagacccagatgcggaagtgatagctttgtcgccaaagaccctaatggcgacgaaccgtttcgtgtgcgaaatctgcaacaaaggattccaaagggaccagaatctgcagctccacaggagaggccataacttgccctggaagttgagacagcggacgagcaaagagatccggaagcgggtttacatctgcccggagccgagctgcgtgcaccatgatccttccagggcgttgggcgaccttacgggcatcaagaaacacttctgtcggaagcacggcgagaagaaatggaagtgcgacaagtgttctaagcgttatgcggttcagtccgactggaaggcccattccaagacctgtggcaccagagaatatcgctgcgattgcggtactctcttttccaggagagatagttttataacacacagggccttctgtgatgctttggctgaagaaagtgcgagagttacagtgaataatactgaacctgttgcaactaggacgacgaccaattcttcatccgacgacggtcctaatccgcgcccgtgtccgccggattctaataaggtctccatttcttcaacaggcggtgccgttgctccgcctccgctctcggctgcgtgggggggacaagcaccgggcgggggcggggccgggggcggtggaacaggatcaggaccaaggctgtccttatggttaggaccaggtcccggtggtccgggtcctccggctactctagatgcagcatcggcatcatcatcgtcgcagtttaatgtaatggacgggactgggacatatccatatcctttcttaatgcgcgcatctaacaatcccagtgaacgttccagcgccgcggcggagctcagtcgtcctgttggtggtggtggtggggggtttatggcaccggcctcgacatcgaccctatttgcaaacctgttaagctcgggaagcgtgcaggcggcacatacccctcccggattctctgaactgattggagctatgactagaggaggaaacggtagtatgggtaccagtactagttctgctaccagtactgctgcacctgccatgttttcaacagctattccagctattttcagccatccacaaccaccaccggtccaccatcagcaacagcaacataataacaccgccacggctcagatgtccgccacggccctgttgcagaaagcggcccaaatgggcgccacggctgccagcaataacccctcgctgctcagaagcttcggtggcctagcaggccacgataactcgtggccacctatgatggcagccgcgaatcacagctctgagccttacccgttgctcagacggctcactgaaggaatcatgccaatgccaatgccgatgcaaacgtccatgccagcttcttcgtcttcattggatcaagtgacaatgcgagaactcatgaactcactatccacgccagcgggcctggggaacctaaccgggcttcttctacagtcaccgttgctcgctccgcacatgagcaatggcaacggcaatggcaacgggtctattggagatcagaccgttgcctgcggcatcattaaggcagaagagctgggtacgtcaatgaagccaacaactctagatttcttgggcctcggaggctctcatggacgaacattatctcactcagactacgccatgatcacatcaatgagcaccacaggagctacaggcaacgaagtgcccgccccctcgccgtataccaaccacaacagtgtggagaataacaggaagcagcagcacagttcttcgccagcaaagtcttgggacagctcatagtcagaaataattgtacacagatggggcattaaacaaaaggtgggccaggttcctctgcaagcttgagaaaatggcagggatgacaacaaatgagaattcaagcctactaccctaccctagcctattttgccgggcatgtatattgtatccattcttgctcagaatcaaacaatatcttgtttggtaagttgttttttgctttaagctctcctcctgtaaatccaagccctcagttcaagggcacgagacgcatgaaaaactcttttaatatatatatttatacatcattcattctttctcaaaaaaaaaa

SEQ ID NO: 2366 - DNA, 925 bp, Eucalyptus sp.; identical to SEQ ID NO: 195

SEQ ID NO: 2367 - DNA, 864 bp, Eucalyptus sp.; identical to SEQ ID NO: 198

SEQ ID NO: 2368 - DNA, 889 bp, Eucalyptus sp.; identical to SEQ ID NO: 197

SEQ ID NO: 2369 - DNA, 925 bp, Eucalyptus sp.; identical to SEQ ID NO: 195

SEQ ID NO: 2370 - DNA, 864 bp, Eucalyptus sp.; identical to SEQ ID NO: 198

SEQ ID NO: 2371 - DNA, 889 bp, Eucalyptus sp.; identical to SEQ ID NO: 197

SEQ ID NO: 2372 - DNA, 864 bp, Eucalyptus sp.; identical to SEQ ID NO: 198

SEQ ID NO: 2373 - DNA, 60 bp, Eucalyptus sp.
tgggtgcaggattatcatgtacggtctgtgatctattgttcactattatgctatggtact

SEQ ID NO: 2374 - DNA, 2266 bp, Eucalyptus sp.
ctcgtcctctcccccccccaccggagcttcgaaatcgagcggcggcgacgcgatgacggacggccacctcttcaataacatctccctcggcggccgcggcggctccaaccctggacagataaagattttctcaggagggatttcatggaggagacaaggaggcggcaaagcagttgaagttgataaatctgacattgtcggggtgacctggatgaaggtgccgaggacaaatcaattaggtgtccgcaccaaagatggtttacattataagttcactggattccgagacccggatgttattagtttgaccaactttttccaaaatacctgcgggttaactccggaggagaaacagctttctgtgagtggtcggaactggggagaagttgatttgagtggtaatatgctgacatttcttgtgggctcaaaacaagcatttgaggtatctctggcagatgtctcgcaaacacagcttcaaggaaagaatgatgttattttggagtttcatgtagacgatacaactggggctaatgagaaagattctgtgatggaaattacatttcacgtgcccaactccaacacccaatttgttggtgatgaaaatcgtcctcctgctcaggttttccgtgacagaatcatgtcagtggcagatgttggggctggaggtgaagatgctgttgttacatttgagggaattgccattcttactccaagggggcgctacagtgttgaacttcatctgtcattcttgcgacttcaaggacaggcaaatgactttaaaattcagtacagcagtgttgttcgcttatttttgctgccaaagtctaaccaaccacatacatttgttatcatcactcttgatccaccaattcgcaaagggcaaactttgtatccgcacattgtgatgcagtttgaaaccgactatgtggttcaaagcacattgtctatgaatgatgatttatttagcaccaagtacaaggacaagctggaaccatcttataagggactcattcatgaagtgttcaccaccatcttgcggggtttatccggtgccaaagtcacaaaaccaggaaaatttcgtagttctcaagatggttatgcagttaaatcatcactgaaagctgaagatggagtcctgtacccactcgagaaaagcttcttctttttacccaagcctcctaccctgatccttcatgaggagattgactacgtggaatttgagaggcatgctgctgggggctcgaatatgcactattttgatcttttagtgagattgaaaactgaacaagaacatctctttcggaatatccagaggaatgagtaccataatctttttaacttcatcagtgggaaggggttgaagatcatgaacttgggagagcagggcgctgatggagtaccaggcgttcttgatgtggatgacgacgatgctgtcgatccccatcttgagcgcatcaggattgaagctggtgtagatgaaagtgatgaagaggatgaagattttgtcattgataaggatgatggaggatctcctactgatgattctggagatgacgagtccgatgtcagtgaaagtggagatgagaaggagaaagagaagtatgggaaaaaggaatctcgaaaagaagtcaaagcatcatcaagcaagaagaaagcaaaagctggagatgaagaggggtcgaagaagaagaaacagaagaagaaagaccccaatgcaccaaaaaaggctatgtctggttataactttttcttgcagacggaaagcgagaaaatgaagagaactaatcccggtctttcctttggggatgtatcaagagaaattgcagacaagtggaggggtttgtcagcggcagagaaagcgccatatacagcaaaagccgaggaagataaaaaacgttaccaagaacagttaagcggttataagaatacttctcaagctatgaatgtagattcagactgatgagggaaaactcgagcactcacgagttcacgatgctatcacgagttcacgatgctagcatttcttttcacatgtaacttgtagcccttgtgcgatgaacaaattgtaccagctgttaggatggatgtgttccgtcatagcctgctatagtgaatttctactggaaatgagatccatatgttgtaatgtttatgcggcactggtagccagtaattctgccgaacgatcattgggtgctcaagggttgccacatatggcttattcattaatcttatctcaggcaggagcccctttttaaaaaaaaaa

SEQ ID NO: 2375 - DNA, 1168 bp, Eucalyptus sp.; identical to SEQ ID NO: 234

SEQ ID NO: 2376 - DNA, 2931 bp, Eucalyptus sp.; identical to SEQ ID NO: 257

SEQ ID NO: 2377 - DNA, 908 bp, Eucalyptus sp.; identical to SEQ ID NO: 1756

SEQ ID NO: 2378 - DNA, 1171 bp, Eucalyptus sp.
gcacagagagagagagagagagagagagagagagaatggcatttgcaggaacaacccagaagtgcatggcctgtgagaagacagtctatctggtggacaagctcacagctgacaatagaatctaccacaaggcctgcttcagatgccaccattgcaaagggactctcaagcttgggaactataattcatttgaaggagtcttgtactgccggccgcatttcgatcagctcttcaagagaactggcagcctcgaaaaaagctttgaaggaacccccaagattgcaaagccagagaaacccgtcgatggagaggtaatttcaccgcgactatggtcttgcctgaaagttttgcagttaggctaaatcagtcattgttctcctgaataaatcttctttgaacagagacctgcagcgaccaaagcctccagtatgttcgggggaacgcgagacaaatgtgtaggctgtaagagcaccgtctacccgaccgaaaaggtaaggatttcctggtgtatttatagaacctctgatgcgaggacatgacttaatccaaaggctgcttcattgagatggcaaaacttctcattgaactagtttgaggaccctcaaattgcaaattaagtacagccattttcatcgacgtgcatacaggtgacggttaatgggactccataccacaagagctgcttcaaatgcacccacggggggtgcgtgatcagcccatccaactacgtcgcgcacgaggggaaactctactgcaggcaccaccacactcagctcataaaggagaagggcaatctcagccaactcgagggcgatcatgagagggaaacaatggctcctgaatcataaaacgctttgatcttgcactaccttgttcgttgagctgtcaccacactttgtggccagcggatttcaggctggtccaaaaacctgttatgctattagagaatctatgtccatctactaaatttgagatgtgtgagccttgaccggtttgatttggcttctgttttgcgattgcggatgatttctcgggttggttgtaagcgtagaataagtggtgcttgcttcttgactttgtgaaacctctgagcttgctttcttttcagtcttgtccagcgagtgtgtctagcatcatccctatttttcattcattcgactcaaaaaaaaaa

SEQ ID NO: 2379 - DNA, 632 bp, Eucalyptus sp.
gggtaagtgaagattcgaaaaacaatggagattgtggggaaggccaaggaagatgtttcactgccaaaagcaactatgaccaagatcatcaaggagatgttaccagcacatgttcgtgtaaccagagatgctcaggatcttctagttgaatgctgtgtagagttcatcaatttaatctcgtcagagtccaatgacatatgctacaaagaggagaaaagaactattgcaccagaacatgttctggaatctctaaagattcttggctttgggagctatattagggaggttaaagctgcttatgagcaacacaggattgagaattgggtggtccttactttctaaactctggaaatgcatgggataggattgtccaagagcaggaactagatggagtaaaaacagattggaaatgacagaagaggaagctttacttgaacagcagagaatgtttgcagaggctcgtgcacgcatgaatagtggaagtaacacttttcctgggcaatatcaatcccaatcccaatcgcaatcacaatcacagtcacaatcggagtgattaatattgaatttttttcatatcttcatatgaggatcatttataatatttttgattagttgtataaatgccatcatcc

SEQ ID NO: 2380 - DNA, 746 bp, Eucalyptus sp.
ggaagattcgaaaaacaatggagattgtggggaaggccaaggaagatgtttcactgccaaaagcaactatgaccaagatcatcaaggagatgttaccagcacatgttcgtgtaaccagagatgctcaggatcttctagttgaatgctgtgtagagttcatcaatttaatctcgtcagagtccaatgacatatgctacaaagaggagaaaagaactattgcaccagaacatgttctggaatctctaaagattcttggctttgggagctatattagggaggttaaagctgcttatgagcaacacaggattgagaattgggtatgctatttctgtttgcaatatttgtgaaatcttaaaccttaacgcatttttacatggtttatattcagatctaatgtgacttgcaaaaaatcttaggtggtccttactttctaaactctggaaatgcatgggataggattgtccaagagcaggaactagatggagtaaaaacagattggaaatgacagaagaggaagctttacttgaacagcagagaatgtttgcagaggctcgtgcacgcatgaatagtggaagtaacacttttcctgggcaatatcaatcccaatcccaatcgcaatcacaatcacagtcacaatcggagtgattaatattgaatttttttcatatcttcatatgaggatcatttataatatttttgattagttgtataaatgccatcatccgatagttaaatttatcagcaat

SEQ ID NO: 2381 - DNA, 1043 bp, Eucalyptus sp.; identical to SEQ ID NO: 291

SEQ ID NO: 2382 - DNA, 1049 bp, Eucalyptus sp.; identical to SEQ ID NO: 1760

SEQ ID NO: 2383 - skipped

SEQ ID NO: 2384 - DNA, 998 bp, Eucalyptus sp.; identical to SEQ ID NO: 298

SEQ ID NO: 2385 - DNA, 1006 bp, Eucalyptus sp.; identical to SEQ ID NO: 1759

SEQ ID NO: 2386 - skipped

SEQ ID NO: 2387 - DNA, 1391 bp, Eucalyptus sp.; identical to SEQ ID NO: 737

SEQ ID NO: 2388 - DNA, 1406 bp, Eucalyptus sp.; identical to SEQ ID NO: 356

SEQ ID NO: 2389 - DNA, 764 bp, Eucalyptus sp.
ctgaaagtttagtcattgaaattagaaatcttgattccggccactgtttgggtgtggtattattcaataatcctgcttccaccatattgatatcgatatgtaatatttcagtttttcatgagggtaagtgaagattcgaaaaacaatggagattgtggggaaggccaaggaagatgtttcactgccaaaagcaactatgaccaagatcatcaaggagatgttaccagcacatgttcgtgtaaccagagatgctcaggatcttctagttgaatgctgtgtagagttcatcaatttaatctcgtcagagtccaatgacatatgctacaaagaggagaaaagaactattgcaccagaacatgttctggaatctctaaagattcttggctttgggagctatattagggaggttaaagctgcttatgagcaacacaggattgagaattgggattgtccaagagcaggaactagatggagtaaaaacagattggaaatgacagaagaggaagctttacttgaacagcagagaatgtttgcagaggctcgtgcacgcatgaatagtggaagtaacacttttcctgggcaatatcaatcccaatcccaatcgcaatcacaatcacagtcacaatcggagtgattaatattgaatttttttcatatcttcatatgaggatcatttataatatttttgattagttgtataaatgccatcatccgatagttaaatttatcagcaatacaaataaatcttaatttcaaaaaaaaaa

SEQ ID NO: 2390 - DNA, 1032 bp, Eucalyptus sp.
gggaaacttgatagaagctgcagagttacacgagttgtatgattagtcagcattattgaaggaacggcaccttttggttcttgcttcgagattttggagcccggattcccgatgtacacaatagcgcatgaaagtaaatacgcaactgcataattttcccttcagcagccatggttacctcacgaatgtcttcggcgatgagaatgaagaaggaaaaaaatgctgcatgtggtgagcatggggatgaactggttcgatgcgacgaaatgcatgtattggcggttgatgattgcctgatagaacggaaggtcattgaaaagcttttgaagactaactttttcaaagttacctctgtagatagtgccgaaagagcgctagaagtcttggggtttcatgaagagcagtcgacatgtgcgaccactaacgcgttcaaggttaatatgatcattaccgattattgtatgccaggaatgacgggctatgatctgctgaagaaagtcaaggaaaccaaatgtctgaaggagattcctgttgtgatcatatcttcagaaaatgtgccgcagagaataacaagctgtctggcagaaggagcaaaagattttatcataaaaccgctaaagcttgcagacatcacgaagttaaaaggacacattaaacctccaaaagatgtagcgagtgtcagcgccagagccagtggtcctgtaagctctaagaggaaaatctcgtccggaagaggtaggggcaaaatgtctgagaggcgtccccgcgttgatggcctgacatcggtgtgacaccatcgatattattcctcgacttttaaggggcctgtgagctattcttcctatggccagaatactggatttctacttgccagacttctataagactacaacataacagccaatttctcgtattttccctatttctttccttgttgtctcttccacactcccatggattcgatcatgggtttcataaatgcaactttggtaattgagaaatggaaatcatgttttacttctaaaaaaaaaa

SEQ ID NO: 2391 - DNA, 2817 bp, Eucalyptus sp.; identical to SEQ ID NO: 618

SEQ ID NO: 2392 - DNA, 1051 bp, Eucalyptus sp.; identical to SEQ ID NO: 289

SEQ ID NO: 2393 - DNA, 1404 bp, Eucalyptus sp.; identical to SEQ ID NO: 334

SEQ ID NO: 2394 - DNA, 1855 bp, Eucalyptus sp.; identical to SEQ ID NO: 364

SEQ ID NO: 2395 - DNA, 1384 bp, Eucalyptus sp.; identical to SEQ ID NO: 363

SEQ ID NO: 2396 - DNA, 1384 bp, Eucalyptus sp.; identical to SEQ ID NO: 363

SEQ ID NO: 2397 - DNA, 1091 bp, Eucalyptus sp.; identical to SEQ ID NO: 1786

SEQ ID NO: 2398 - DNA, 1296 bp, Eucalyptus sp.
agcaagttcaaggcttggtagaaaagggcacggaccagagagagtcgcagaagaagacgaacagagtcgagaagagagagagagagagaagatgaagaaggcgcagatggagttaccagcggggttcaggttccaccccacggacgaagagctggtgagcgattacttgattcgcaagtgcgcttcgctgcccatctccgcccccatcattgccgagatcgatctctacaagttcgacccttgggaccttcctgaaatggctctgtatggtgaaaaagaatggtacttcttttctcccagggaccgcaagtaccccaacgggtcacggccgaaccgggcagccggaactgggtattggaaggcgactggagccgataagccgatcggccgcccaaagacgcttggcataaaaaaggcccttgtgttttacgccgggaaagctccgaaaggagtgaagacgaattggatcatgcacgagtaccgcctcgccaacgtcgatcgatctgccggcaagaagaacaactcgaggcttgatgacggggttctatgccggatatacaacaagaagggcaccatagagaagcatttcccctccgcgcacgataaaccggcagagttcccggaaatggagaccaagccgcagattgtcatgccggcggcgatgaacccttacaacacacctccgcaatatgggtcgctaatgactatggatcacacgtacatggactcgtcggagtcgatgccgaggctgcacacggattctagctgctgctcggagcacgtggtgtccccggattcggcgtgcgagaaggaagttcagagcgaggtgaagttggaaggttgggagaaggccctcgatttccagttcgaatcgatggatgacttcttggacgaggcgttcgcgcaaggacagtatcagttggatctgttctcgcctcttcaggacgcgtccacgtacttgcagaagccattttgagcaagtccgttgagaaaacagaagtggagttctcgatgaaattgcgtgatccaccagcgtggtgatgaatcaaagacaatctctgtcttggacaaattgctcgtgtgggggctacagacttgagagtcagtcctgggattttgctggagagagaagcaagtgttgaggtgcatccagtagccaccggagaaaaaaatttgtagtgcttggcatcatgtcacctcttgttgttcttgtaaatacctgatgaaaatatccagggaaattgtttcctgtaagattgtaacaacattgtttcgaaatttcatttagagaaagat

SEQ ID NO: 2399 - DNA, 1021 bp, Eucalyptus sp.; identical to SEQ ID NO: 383

SEQ ID NO: 2400 - DNA, 1903 bp, Eucalyptus sp.
tcaattcgagacaaattcggcgcctccagcattcaagaggatactctctctctctctctcaagaagaagaagttcgcttttgcttcgtcgtcctccgccgtcttcctccgcttcgcttggttctgaagaacaagacaagaacaagaacaagaaaaccgaccctttgtcttcggcgttccatggattcttcttcctggattacttcttctttggatctcagcattagaccgctgcaagtttcagaagaacctccgaccaaagtggtggagagcgactttatggagctgggaaggactggttctgggaacaaagatgagagtggtgctctgcatgaagaactgaatcggctggctgctgaaaacaagaagctcagtcaaatgctgatgacggtgtgtgagaactacaatgccttgagaaaccatgtgattgaaattgtgagcaaaaatgctgagagagaagtcagcccgtccaagaaaagaaagtccgagagcagcactaacgacaatggcaatgagatggtagttaatagagcctcggagagcagctcgacggatgatgatgatttgtacaagaaaccaagggaagaaacaataaaggcgaagatcacgagggtttattataggaccgaagggccaggcactagccttgtaagtcaaaagtgccattcatacattcttgttccagagttgagctctaggagttgagctctagcttcacaaattgtcgctcatcgagctatctcgtgtgtgttgcagattgtgaaagatggacaccagtggaggaagtatggacaaaagatcaccagggacaacccttgtcccagagcttacttcaaatgcgctcacgctccaagctgccttgtcaagaagaaggtcagccaagaacattccccctatgttctttttgtgaaatttcagattatgagagcagtactatctgctagctgctggctttttttctaatctactgtgcaaatggtactttactaagaattatacttaaaagaatcactcttggaattgcaggtgcaaagaagtgctgaagaccaatcggtcatagttgcgacttatgaaggcgagcacaaccatccaagttcatctctactcgaggcaacatgtggctcaaatgcccgtgccactcttgattcggttccccgctcggcttctcttagttcatctggacccactgtaactctcgacttgatgaaacccaagcaggaaaccgatgtcaaaagttcgcaaccgaaagtagattcaccagaactgaggcagtttctgatagaacaaatggcctcttccttgacaaaagacccgagctttacgactgcacttgccgcagctatttcggggaaaatggtcggcccatatccaactgaaaaatggatataaattggcgagaccaggatgatttctcatcgtttcttgaaaggaattccaggaggtgtctgtacatacaaattaggagggaaaaagcaaacaggaaaagttctcaagcttcagagtctgtccaacttcaccattgactgctgctgcacgtgtttgaacatttcaagttggaagtagttggagttgcatttcagaacagaagtcaaatggttcgttctagccgttgttgaatgttgaatctccaattcggtggatatatcaactcatcacgacaaggattttaaacttgaaagcaccccctcgtgtactcccttttgacatttttctaatgtatctagcgtaccctctttgacatttctgttgtcttgtaacatttcctcgcggttgaaagttgaaaggtcggatgcatgaaggtgacaagcacgacttctagactaacagcccaacttgtttttcctctttgattccatccgtcttctcttgaaaccataataaattagttttcgtgaaaaaaaaaa

SEQ ID NO: 2401 - DNA, 898 bp, Pinus radiata
gtttgacaaaaatgaccggaagcggctttttaacttgatgaatgaacttccaacaatatacgaggttgtcactggaactgcaaagaagcaagtaaaagaaagatctacagttaccaacaacagcagtagcaaaaacaagtcaggagggaaggtgcggtcatctgaatctcaaccaaaaatgtcgaagttaccactatccaaggatgaagaagatatcttagacgaagaggaggatgatgaacatggggagaccctctgtggagcctgtggtggagtttattcctctgcaactgcagaattctggattgcatgtgatatgtgtgagaattggttccatggcaaatgtgtgaagatcactcctgcaagagctgaacacattaaacagtacaagtgtccatcttgcagtaataaaagagcccgtgtttaactacaagcaaaatattatctaatgtttcaaagaaatttgtggctccagccaaaagtgtttggaggcattggagctttgtttcttgcaattgaggttgatgattaaggcaggctgagacaccgtgtgacctttgaggtcagatagacaagtgcaacatccatttacatgctgagctagttacttgtttgtttttctgatcgtaatttgtaggacttcaaaagttttgataactctctacgtaaagttatacacttttgaaacctttgggacgtcatgaagaatacagctgtatgcatgttggttagttgctttttatttcttaatgcacattgtaaaacacgacagtttgaatccatcaagggtttaatgttgaatgggataacctgtgttcttcagagtagccatgttggatacacttatttttatttgtatgctatgcttaatacgctattcagttttttaaaaaaaaaa

SEQ ID NO: 2402 - DNA, 2881 bp, Pinus radiata
gctatagattgatagttcagagaaaagactgaaaggcaaaaactatatagacataacaacggagagagcagcacaggaaccaggttgcataatggctaggcctcaaagatacagaggagtccgtcagaggcactggggatcatgggtctctgaaatccgccatcccttattgtaaaaactttgttctctgtctattcttaattcaccatgactgtaaaatcttgactctctatttattgtgaattcatggctgtaaaatctcggttcaatatctctggagaaaatgctgtttttgcactgactatatacatatccatttggtttccacctcagaaacccaaggaggttttcaatttacttcgttgtttggctgcaatgtttgttaagtatatgcattgctgcatccaattttcctaacctggtggggttgtcagttcaacatttgtatattgacaaggcagcttctttttggcgttgtaattttttgatggttttgctgttacaatatcacaattgggttccctacattttgaaatggctgtttgaattgtcttgaattacatttgatctaacaagacacttctgttagaacaagtaaatgcacttacaggtcttttgggttggtgttttaatgcaacattgagtacaatatattctgaccgtgaccattgtaatccatgtgtaatgttgctgcgaaacatggccgtttgaattagcctgaattacatttgatctatcaggacatttttgttagaacaagtaaatgcacttacggctcttttgggttggtgttttaatgcaacattgagcacaatatattctgactgagagcattgtaatctatatgtactctgtaaataacgttgctgtgaagtctgatatactgatgttgattttgatgttccttattgtttgaattgctttgtcatatatagtatgtacatgttcttttccatactctcctatctgtcaattggtatgctttgattgaattgctgtgtaatgtacagtttgtatgtttctctttcatattctcagatttgtcaattggtatgcttttcttatgggaattgttatatgtatatatatatactatatgtacttgaatctagtatgttgcacttttttagccttgtgttgtgctcatggagctatatgctttctcaaactaagaactaggtatcagtctctcatagagctgtttgacatggagaattggatatgtgcatttccaaactaagaactctgtatccatccttctgtatcaagtatttggatgtagttgttgttctgcttttggtggttaatgctgttcaatcatattgacattgatatccttatggaatgttttgcatgcaacttgtaacattgttgatgcaaaatgttgtgtgttcaaaaccccaaaaattctttatcccaaccttgttgatccagtgttccatatttatatatctttggtattctgtcttttgtggtttaatcttgtattctcttcttgatactgatgtcctgatgtcctgtttttagtggttaatgctgttcaatcatgtaaaattgatatccttgttgaaagttttacatacaacttgtaatgttgttgatgcaaaatgttgtgttcaaaacccaaaaaactctttgcatcaaccttgttgatccagtatctcatatttatatatcttttgtgtcctattttttgtggtttaatcttgtattctcctgttgattctgatgtccttattgtgatggataaattataacttttctcactgtgatcattgatgtccacggtattgtaggaagaccagaatatggctaggaacatttgaaacagcagaggatgcagcacgagcatatgatgaagctgcaaggatgatgtgtgggccgagagctagaaccaacttcccattcaatcccaatgcacctccatctccatcttcaaaggttttgtcctccacgctcactgccaaactacaccgctgttatctggcctcgatacaaggaccgagatctggctcatcgaagaaggatgccatggcaagagctgataaaaataacaatatacatagcagcaatcagtccctcacttgcttaagattggataacgaaagatccaacaacattggtatttggcagaagaaagctgggtctaagcaatccgaatcaaattgggttatgaagttggagttggatcatgatcagcatggaaacagtacgctgaaacgggagacagatgatgatattgctcaaatgattgaggaattacttgactgtggatccttggagatctgctctcccatggcttctgctgattctagtatcagtagtgcagagtcgatgcttaattagcctttccagtgaatgttaagtctaatggccagcatgaaattttgcatgaatcctattagattctggatgtgcaggagaaattcttactcatgatctgcaaatttgctcagtcaaagacttgcaaggtgcaatttatgtgaggccatggaagttggaaggcttgatctatcagagaagttttataatctcaatcgtgatcttccacacctatattatagtaacctagcccgattttgttaaagggttgtagagatataggatatcatctctctgatctctttgtgcgctcctgggagacatttataatcaagtttctatataaatagccttttggcgtagtcttgtagctgttggcttcttttgttgaagcttgtggctaatatacttcacttaatgtatatctacaaaaattacagtcagtccgcgctccagtgatgatggtgagtgaccatggcatgactgatggtagaagttagaacagatgcttgtggggaaaatataaggaataaaatattttactatagcaaaaaaaaaa

SEQ ID NO: 2403 - DNA, 1950 bp, Pinus radiata
gatcgatcccctcccagatgatcttcaccgagctcacagaacctgcaattctgtgttcgatttctatgaattaatggaatattatggcaatagttctgcaatgccaagatatctaggttccgcggttgatcctcctcctaccgattggaattcgcaacatgttgctgcggatttgggcatggaggaggcaatgcggcaaatgaacctgcaatctcatgatgttgcagaaaggggactctttggaccctttccagagagaccaggagagattgattgcgcacattacatgaggacaggaatttgcggttttggcatgacctgccggtttaatcatccccctagaaggaatattgctgcagcagttgcaagaaacagaggcgagtaccctgagcgtcctggtgatcctgaatgtcagcattttgtaaagacaggaacttgcaaatttggtgctacctgcaaataccatcacccaaaatacaaggctggaacatcagactggcagcaactgaatgctcttggctacccattgcgcctgaatgagaaggaatgctctcactatgttaaaacaggacagtgcaagtttggtgtcacttgtaaatatcatcatccacagccagttggaccatcagttgcaattgctggaccttcatattatccaactggaccttctttgtcaatacccagtcctcaacaatatgcgggagggctaacgacatggccaatttcaagaacgccactaatggccaacccctatctgcaagccccctctacttatgtaccttttgtgattccccatggaatgatgccagttcctggctggaactcttttcatggacaagtgggctctataacttctcgtgatctggggcaacaagcacctggaactggtttattctatggccctaggtaccaaacagatggaatgaaccctagtattcagggggcactggcttcatattcatctcgatcaggttcaatggggattccatcaaccaatacacaaatggagcatatgtttccagagagacatggtcaaccagaatgtcaattttacatgagaacagggtactgtaaatatggttcaacatgtaaatatcatcatccaagggacaggactgttccattgacaagctgtactctcagccctctcggcttaccactgcgttcgggggcccaaacatgttctttctatgttcgtcaaggattttgcaaatatggaccaacttgcaaatatgaccaccctatggggactttgagttacagtccatctgcatcttcactagcggatatgccagttgctccttatccagtaggatcggcaccagctactcttgctccatcattttcatctacagaattaaggacagaaactactgcagggccgttcaaagaatcaattcttactccagaaactcctttgtcatcttctgctggcgaatctctagatttaggagtacaaggtccactattaagcacctcaacaggtttgacttcctctgaaagcgaggaaaatcctctggttaagaagtcaaatcaggtttctgtccttgcaaatgggattgcaaaggagggggacattcccatttcaaattgaagacatcatgtaagcagatcctaatggttgtgactggagtcttctgaaaagtggtcattctgttctatatctttcatgactgtcacatccccaatgtgctgagaaagctgatggaaattcactgagaaaatacatctggtttgggaccaagccttcttcctttggtttctgtgtgaatttctggaactccaagtttgaagcccgtttttcgatttcacttccacgggtccaacgctgtgatccagttccacgaggcttgccccaaattaatgtgatatattttctctggtcttatgcttaaccgcactttatttaatttcattcacaattttttgttgttgttgttaaaaaaaaaa

SEQ ID NO: 2404 - DNA, 1133 bp, Pinus radiata
gaaatgtgcgaaagagttcaggattgcagacggaaggaatcgataaatagcaggatttctgaaacgagcgacacacccacgagaaggtttccattacgacgctgataatgaagagcaaaaccccagatttgacagaggaacgggaagtctgagaagcggggcttgcagtatggacataccgggcggcgaagaggaagtgatttcgatgccgatatcgaccagtcttacggccgttagcgactcgtccaggctgagattgctcgcagccgcaagcacgccggatggaaaaccgcctgaaaaaggatcagaaggcagaaaaacggtgagatacagagaatgccagaagaaccacgctgcgaatctgggcggacacgtcatggacgggtgcggcgaattcatgcccagcggggaggaggggacgccggagtctctccgatgcgctgcctgtgaatgccaccgcaacttccacagacgggaagtggagggcgaggaggcccaaaccgcctgcgacgtttgctatcacaagggactcgtctcgggttcgaatctcatcccgctgtcgttcccaccgccggccataggcgttcttgggcgggctctccctcagatcattgcggccgcgcccgtcaataataataacatgaggagcagccccgcgtttgcgccctcaccggagtccgaggaacaggcggacggaaacttgccgtcggggaagaagcggttcagaacaaagttcacgcacgagcagaaggagcggatgctggcgtttgcgcagagagtggggtggagactgcagaaacacgaggaggctgccgtgcagagcttctgtcaagaagttggcgtgaagcgacacgttctcaaagtgtggatgcacaacaataaacacgccatggccaccaagccccacgctgacaacaacaaccacaataacgacaatacggccgcggctaatagcagcagcaataactcaaccccataaaaattttcagtaagctctgttatttcgctcccatcttctcaccagagttttgcttcttcaggcttccaaatattcgtcctgcaggcaataaatctatatattttttaaagtatatattgacacggatgatgtcaatactaagataaaaaaaaaa

SEQ ID NO: 2405 - DNA, 1194 bp, Pinus radiata
cgcaggttttcggatgcgcctcccgctacattccgaacaagggaacaggtgccttatctatcaataaagacgagccaaggagttgcagccaatagaagtggacaaactttctctctggtgtggggagcactcaaaatggggaagacgaagatggagattaaacgcattcaaaaccctagccgccgccaggttactttctcgaaacgcaagaacggattgctaaaaaaggcattcgagctttctgttctctgcgatgctgaagtcgccctgatcattttctcggaaactggcaagatctgcgagtttgcaagccacgacgacatggcaacaatactggaaaaatatcgaatatacacggaaacagatggaaacatggagtcctcgtcggtccaaagcgtgaagattggtgaatcacaactcaaagctttgcgtgagaagatgaacaagctgaagaaaaaggaacgaaacatggttggtgaagacttggattcattaacgataaaggaactgcaacgacttgaaaatcaattgcaaattgggattaaaagaatttctgataaaaagatgaaaatattggtacaaagttccaagttattactacaaaaggtacgcgcgttggaagaggagaaaattgaacttgaaacgaagttgcgaattaaaggctattccttcagttcagccactaacctaaatcttggactttcgtatagtaccatgcccagcgggctctgcgacatgaacagcaatggagattccttctccgttgagataccttaatcgaatacaataactaaaatttctcagtacggatctatccactatttattgcagcttcttcaaccaaatcatgtattagaagtccccaaacgtatatatatatatatgagacggtcatgtatattttaatccttctgatttacagaaggtcacttccccatttccatattgttaaactaaattacacagaaaagtgacattttaccatatgttaagcacggagcaccatgtggctgctcctatttgcatataaattaagcgtggatgaaattttaattgtacatgtaacagtgaaattttatttgtatactgataaaagaatgcttactggttagatgaagtgatttgtaatttgtgaagagtgtgataaggaaatagagaaaaaggttgtggaatttgcataaaacaaaaaaaaaa

SEQ ID NO: 2406 - DNA, 2270 bp, Pinus radiata; identical to SEQ ID NO: 634

SEQ ID NO: 2407 - DNA, 1324 bp, Pinus radiata
ccgcctcttcttatactagtgcctttatcggttccattcaaacttgctcacggattccgacccttccggctaaagctgcttcatttctgtgtgtattgaagatggggagatctccctgctgtgaaaaagctcatacaaacaaaggggcgtggaccaaagaagaggacgatcgcctcatcgcccacattcgaactcacggcgaaggttgctggcgctcgcttcccaaggccgcagggctgatgcgctgcgggaagagctgcaggctccgatggataaactacctgcgtcctgatctgaagcgtggaaacttctcagaagaagaagacgaactcatcatcaaactccactccctactcggcaacaagtggtctcttattgcaggcagattgcccgggcggacggacaacgagataaagaactactggaatactcacatcaagagaaaattgctaaacaggggactcgacccccagtcccatcgccccctcggccagccgcacaacagcaacacgacctgcccctctctgcccgccctcgagcacgaaattcttgtgttccagaggccaagaacgccggagatagcagatttctttcaatacgagcgctctgaaagctcgccgatggaaccggccacttctaaagacgcggaagagcatcccgacctcaatcttgatttgtgtatcagcttgccagttcattcgccccccgccacgagcagagcttcgagcgtcgatggaaccgtggattcaaaacctaattcggtttcttgtcacatggggttgcaagtaaattatggtgtgcaatgtgagaacagatattgtgaagagagtgcttccggtgtctcgagtttttacacgctcgtcttatagaagatttgagctttatggtttgcttattaacaccactaagcattcatctgatgaataggcagagtgaaactatatgtttgctcattgtggcagcccggagtttgcagttaatagacagggacgcagctggacagcagttacccaaattattgtttaaagagtgtagatagctcacctatgaacataggaatcgctgtttcaccatggcgctctgtaatatttaaagcgattcatatggaagcttgagcgcgaagtctccagtgccgtatcatcaactaatgtaattgaactgcaattggtcacatgcccgtgtaaataatgaaactatgagtttcatattttccaagttttactcgctgttccgcacagctttttttatatatgtatttggcttgtattgaatatcatatttatttgaagatgtaatttgcggtttgtatggattaaaaaaaaaa

SEQ ID NO: 2408 - DNA, 1339 bp, Eucalyptus sp.; identical to SEQ ID NO: 352

SEQ ID NO: 2409 - DNA, 1012 bp, Eucalyptus sp.; identical to SEQ ID NO: 345

SEQ ID NO: 2410 - DNA, 1765 bp, Pinus radiata; identical to SEQ ID NO: 732

SEQ ID NO: 2411 - DNA, 1402 bp, Pinus radiata
agaagaagagagtgaaatagagtgaaatatctctatcagaggccaggcagggtagaagcaaccggtcatcgaggtcaggaatagcagaagcagtagcaggtcagaggatccacagtattgagaagaaaacattggcataagcatgggaagaagagatgcagaggcggacttacaattgcctccgggattcagattcttccctacggaggaagaattgattgtgcattacttgtgcaggaaagcggccttgctgccactgcctgtttccataattgcagatgtggacctctacaaatatgatccatggcagcttccagagaaagccctgtttggagagaaggaatggtacttcttcactccccggaatagaaagtacccaaatggttcaaggcccaacagggcggctggctctggatactggaaagcgactggtgctgataagcccatctcttctactgcttctagaggagtaaagaagagagtgggcgtcaaaaaggcccttgtcttctatgttgggaaagcacccagcggctcaaagaccaattggctcatgcatgaataccgtcttgccgatattaacaggcctgcaaggaagaaagacagcttaagattggatgattgggttctctgtagaatatacaacagaaaaatcggtgctgagaaattagcactagagccgaaggaaagcttcaatgatgtaccaatggaaaccattgatgaaaaggagatgaaggatgagcccacctcaacttcaatcaatcatagcgcctttgaacagagcaacccgtcctttgaccatttgagcaaactgggatcttctccaacatgctacaacgccgttccccctggtgcttctcccatgaattccaatatccgtgtccagaatctggatttcttgcaaaactcaagcaccctttttagtggcagtacccttaaggctccagcgcagaatacagcattcaacccaatttccccctcacagacaaattggaattcaacagagttaatttcaggattgcatgatgatttcagctgttccaaggcaccatcattttcagaacccatttgggagaaagaagaagttgagagcagcttcagattggaaaatatctcgcaggagcagcaacaatcattatttaatttcgatctagaaggtctacaaagttccttccctcatttggaccagatatcttttagtgatgcttatcaagactggtttctagtctagcgagccatgatccagtggaaggtctattagcctttggttttattttttattttttaaagactacctctaattccattgaatttatggacttacagcagttctaactgacagcatgttacatcatttttttaataaaattatgtctcgcagggttctcccgcatcaaaaaaaaaa

SEQ ID NO: 2412 - DNA, 60 bp, Pinus radiata
ttccctttcggtaaatacaaactacctcacctgcatggtctgtaatatgtaaaggactca

SEQ ID NO: 2413 - DNA, 3201 bp, Pinus radiata
gaaaccctgatgtaatcagaagctgcagagcgcaaggaggagaacgaagagcagccatggcggatctgctggacgatcccgtggctttgactttagatgcaggggactgggaatgggacagcgttttggacttctcccccggctctttccctggtcatattttgccttggcagtccgaagaactctcggatgaacgattgttaacttcccaggcccttgaagttcagcaggtacgggaggtgcaaaatgcatctcccaggaatcaatcgcacgatgcggaggaagatgagaaggaggctgcgtccgggcggattcgcaaacgggaccctcggcttacctgctcgaatttcttagcggggcgggtgccatgtgcttgccccgaaatggacaacatggaggaggaattgagccgaaaacgagccaaagttgtcgtgttgcgttgtcaggtgccaagctgcgaggctgatatcagtcacctgaaaggttatcaccggcggcaccgtgtttgtctgggttgcgcgaatgcggccatcgttgtgctggacgacgtgcctcagcgatactgtcagcaatgcggcaaatttcatctactcacagattttgatgaaggtaaaagaagctgtagaaggaaattggagagacacaacaataggaggagacgaaaacctgttaatgttgttgaaggttcagtgcaacaacagactttaagagcagaatcagcattgcagaatgcagatacagagcctcacaatgatggtaaaagtggacaagcatcgaagtcattttcatctctgggctgtggtgaaaagcaagccagcagtgggagtgaagagataaacatttcagaagtagagcaaccatataaaggtgatctatctttgaagaatgtgggatcgaaatctgctgatgttagtaaagttaccagctcgatgccagtaaatgtttctacagaacttgaagggaaactacttccagaaagggatatgggaaacggagaaaaatttaatgatcaggatgtgagagttgtggacaatagtcaagcaatcttgtgcgtgggacctcaaaatggtgataatggctcaacttatgcagaactcaatgaacaatcttatactgggatgccgatggaagaaagctctcgtaaagataggtttccacacaatgcaagtgggaggagcgaaagggatgaaggagctggtccattgcaatcttctctttcttcaaatagacatgacaagcacttctcgtacgcatcagtgtgtccgacaggtcgtatatccttcaagctttatgactggaatcctgcagagtttcctcgacggctccgtcaacaaattctacaatggttggctgacatgcccattgagttggagggctatatccggccagggtgtactattttgaccgcttttatttcattaccgcagttcatgtgggagaagttatctgcaaactcgccaggatacattcatagtcttttgaatggctctcaaagtatattattggacaagggcaacatgcttgtgtatttgaatgacatagttatgcaaattaaaaacggtgaagcatgtttagttaatacaaagatggatatgcgaattccaaagctccattctgtccatcctattttttttgaggctgggtgtcctattgaaattgttgcttgtggcaggaacctcttccgatcaaaatatcggtttctgatatcttttcacgggaattatattcattatggcacatgtgaagccattcctcttggaaatccaagctcatgttttagaagcaaggaaaatattttccacccctcaaatcatgaatcattcaaaatatttattccatcaactgatcccaggttatttggcccagcatttatagaggttgagaatgagtatgggatatctaatttcatccctattctcataggggacaaacaaatttgttcagagtttcaaatgctcgagcaggaacttgtgaaatccggattctgctccagaagtaatcatggacttgctatcggaagttccagttctgatatttgcgagcaaaatttggtgaagaggcagagtatcttggagttacttgtagacataggttgggttctcaaggatcccgaatctgatgaggataaagtaccagtgaattttttacacatacaaaggctgaattgcttgttcagttacttaataaatggccacttccttgctatcacggagaaagttttgcattcacctaaagttgttaaaatgttaaggcaagtatatggaaagtcaaatgaggttaatggtgctgacatgaagttgcttcagaattatgttgagcatgcatggcaatcgcttaggaaacagcgggattataagggtactaccgatttccagtcgttcctcgataacgtagtactgcaaggttttcctcctccattgacaattgcaacattatcttgcaaccagcagcgctgtacagtatctcatgaaaaccaggaaacggaacgtttattgaagatccaacctgaaatcagacctttctctgaaatagaatcaagtgatacacgtgttttgtcagttgaagaaaataacatgctcacgcccttgcttgagaaggaatgctctagcaatattgcaggtgacttgaagtataactcaacatggagaggtccaaaaatagaggttgctgagtacactcgaaagatgaaagtttgcctaaaaggtgatatcagggtcgatcgtcgaatctttatcttggcaattactgtcatttctgtttgtgctggaatctgtgtggtacttcagcatccacaccaagtaatggagatctccatgtcactaagacgatgtttatctggcttgcgcaaagctcgcgaagacatttcacacccttaaataagcatggcactgcttagtggccatctcaaattaatgagtttgtatctttataactacagaaattttcagctcaaaggttctgcagtcttcttgatgtaacctattaattcgtaagcggccagtacgcacctcccaaaccatggagacagtgtgcgtgcgtaataagcccaagcttcatcagctgaaattaaaaactatttactgttcaatgtaaaataacaatgaatcagctggcatttttatcggtaactgctttctggtccccttgtataagtaactatcgattttcagttaattcctgtgaagcctgtgaaaaaaaaaa

SEQ ID NO: 2414 - DNA, 872 bp, Pinus radiata
cgcctgtagcgcagaaccagggtttcaacgaggccggcagtgctatttttgttatttttattatttctaacatcattactatgaccgtgaaaaacatttttcaggacatgaaaggcagtatcgggagcatctccaggcggagctttgaagtaaagttccttagatctcgttcacagagtgctgtggacgatttacattatagaagcaatgcgaataataagaataatagtaataatggaggcttgcagtgcagtttgtgggcgaatatgccccctgagttgataagagatgttattcagagaattgaggagagcgagagcagttggcctttcaggaagagtgtggtggcatgtgctggggtttgtatgacatggaggcaaattacaaaggagcttgttccgatacctgagctatctgggaagcttaccttccccatttctttgaagcagcctggatcaagggagccctctgtacagtgtttcatcaagcgagatagggctacatctacctatcaattgtttctctgtctgaatacaatacaagatttgaacccaaggcttctggtttggtgagacttcatttccacagccgttgccaattgagctactccaagtagacatttttttaaaaagcttggcaggacaagacatcttcatcttgtccaatatatcgccgtgattggggcatgggattaaactgattcacatcaaggagtgccttaacagagcacccaatcgcggtctatccaaaaccctgtggattatttcttatttttattaattgaaaatttcaatatgatttgcgtacagctattataagattgttaacaaactttctaatatagtattagactttgattggcaaaaaaaaaa

SEQ ID NO: 2415 - DNA, 2048 bp, Pinus radiata
gggaatccctgcccaggataccgaggaaagaaagcctcagataatttctgctgctgctgctgggtctgtgatggataccatacagtacagcgggaacgggaacggaaacgtgaatcttgctgtgaatggaatgctttcgtccggcttcgggcacaacataatctcccctaattccatgggtaacctgctcatgagctcttcctcggcgggtacaagaaacacctatggaggccacaatcatcatcaacaacatcatcatcatcataataatcatcatgtactggacagcatccgttccagtgctccgtcgcctcttctgtattcaggcgggaacagtgctttgtcggggttcgggtctggtgtgtacgccgattccacccgcgctgccctggaagaacacaggaaccacattctgggtttgatgggcatggaccagaagaacgtctttcacaatatcgtgaaaagggaagatctctgtggcgcaggagatttccagacgagaatcgggctaaacttaggactaggcggtagaacttatttttcctcagaggacaatatcgtgaaccggctgtacaagaggcccagggcaatttcaccgggctcgcaggtgcccagatgtcaagcagagggttgcaaggcggatttgagcactgcgaaacactatcaccgtcgccataaggtctgtgaattgcactccaaggcagccacggtcgtcagtggtggactcactcagaggttttgccagcaatgcagcaggttccacgtcttgtctgagtttgatgagggcaaacggagctgcagaaaacgccttgcagatcacaatagacgcagaagaaaacctcaacccaatgcagttgttacagtctcgaatactgaatcatcttctgcgctcaagaccactgatcaagatcaagataccaacagcggaagcaatcagtcaagtctgcagcagcctgaagtacagatttcccggtcggaaccaccgggcttgttgaccggaatttcactatcccaatctctaccactggttctccaaaccagcaaaggacaagagcagtatttgcagcaaacgggcccaaatttgtccctgggaggagaaattgctctggactacccgagacacagctctgggggggagaattacaatgggcttgaaatacccattccatggctgagacctgcaggttccggatcagaatttggtggatctgagaagaatagctccaatggacaactatcagaatctggtaatggtggtgggagctcttctactgttcaggttttcacatccattcagaatctgctccctcttcaatcctccacagaacttggaacttcggaatggatggttaatggaaatctctctggttcaagcagccgaggccagcattatgggtcggccgatctcaatctccagaccagtctagaaggccagcagatgctcagtttgttggagaaagacgtgagatcatccaatacagaccgccacaacactgaggatgcagtagagtacttttcacaacagcaaggcctgaattccaagaattccattgatgggcattctgagcaccgcaatcagctgagttcaagcttcccagggattcaatctcttagaactttgagccagtctctgtatcagaacattttgtgaatcgaggaaaagtctagacattgaaagctttttcggaaactcactcttcttcaagtctctaattaagagaccaaaagtcttacatccaccacagcgtaattgggttgacttcactgcaacaacttcaatcggatttagccaaaacaaatggtccatgcccatgcccctgtccatgtccaggcaagcatctggaccctttgagctgctgctttctggaaactagcttccattaaaacagttatcataacttgcacctcatttttactgtagattattatatgatctcaagagctttagagcttttcctccacccttttttgttcagctcctatcctgcaattattttgcaaatgtaatcgggccgagtacgctctatatcctttagtttaaacagaaa

SEQ ID NO: 2416 - protein, 232 aa, Eucalyptus sp.
MSFLDEFQADLEALPNILQKKYALLRDLDKSLEDLRRQNEQRCEQEIEEIKQGVKSGNTFSDEVLDEQRHSIRIADEKVALAVHAYDLVDTHIQQLDQYLKKCNEELRRDKESVPPEGISSSSVDASTKPGRGSESGRGGRKNTRLATQAATEATNAASTNPPGMELDIPIDPNEPTYCFCNQVSFGEMVACDNPDCKIEWFHYGCVGLKDVPKGKWYCSDCAGLKSRRKGR

SEQ ID NO: 2417 - protein, 151 aa, Eucalyptus sp.
MAPREKPSVAAIPNPNGAKEIRFRGVRKRPWGRYAAEIRDPGKKTRVWLGTFDTAEEAARAYDTAAREFRGAKAKTNFPTSAELISSSRSPSQSSSLDEPSPPPPAGAVQAAALGPPLDLSLGGVRQAGARQIAPRPQPPPTGGGLKFFPA

SEQ ID NO: 2418 - protein, 349 aa, Eucalyptus sp.; identical to SEQ ID NO: 1977

SEQ ID NO: 2419 - protein, 302 aa, Eucalyptus sp.; identical to SEQ ID NO: 2119

SEQ ID NO: 2420 - protein, 332 aa, Eucalyptus sp.
MQPKSKISNGVDAHPHSIQTSAVFTEPWWRGYNTISPADPGRNETHAPLGCINGGSESNGGQSQSNEERVEEDDDDDNVKGSGNPACSGAVGNQGQGPQNGHGAPTIITMRDDGLAQPPQLELVGHTIACASNPYQDPYYGGLMAQYGHQSMVRTPFVGIPHARMPLPLDLAQEPVYVNAKQFQGILRRRQARAKAELEKKLIKVRKPYLHESRHQHAMRRARGTGGRFAKKSETDASNDAAEEKGTNSGPALSSQSASSSGSEPLAPDSSETWNSSSNHVAGRSQVHGTHRGHDYVNGNSQYKNHGHFQASAYSNERERDRFGQQPRERLL

SEQ ID NO: 2421 - protein, 260 aa, Eucalyptus sp.
MDQQGNGQTPAIGVSSSAQMSYGLSPYQPNQMAGGAPPGSAGQMQPPQPASSAQLAQHQLAYQHIHQQQQQQLQQQLQNFWTNQYQEIEQTTDFKNHSLPLARIKKIMKADEDVRMISAEAPVIFARACEMFILELTLRSWNHTEENKRRTLQKNDIAAAITRTDIFDFLVDIVPREDLRDEVLASMPRAGGLPVGPPAEGVPYYYVPSQHGPQMGVPPGVIASRPVTDQSMYSQQPHPYMAPPMWPQQQPQQQQPPADS

SEQ ID NO: 2422 - protein, 518 aa, Eucalyptus sp.
MDGAGDDGAGGASKQSNAPAAAPTPAPAPMSSANAPPPFLSKTYDMVDDPATDSIVSWSATNNSFVVWKPAEFARDLLPKYFKHNNFSSFVRQLNTYGFRKVDPDRWEFANEGFLRGQKHLLKSISRRKPVHGQGSQQPQQPPGQSSSVGACVEVGKFGLEEEVERLKRDKNVLMTELVRLRQQQQATDGQLQTMVQRLHGMEQRQQQMMSFLAKAVQSPGFFAQFVQQQNESNRRITEVNKKRRLRRDGLSENEHTAASDGQIVKYQPPINETAKALFRQMMKVEAPQQESFDDSPESFLLGDGSSLSSGMDSRTSSRISGVTLQEVPPTSSQVPEIPPALGASANDPSSAVSELKAPSQGTAKVTTNQFPDMGMLAGAQESEAVSVNQADTVMTGISQTQDMVLEDIANISRDDYMGADLHNGDYMDPASFMNGSMPIEIDSISPDPDIDALLESSTFWDDLLMQNLLPEEGESTSAEAHAGANDAQPMENGWDKAEHMDQLTEQMGLLASDNKGI

SEQ ID NO: 2423 - protein, 188 aa, Eucalyptus sp.; identical to SEQ ID NO: 1091

SEQ ID NO: 2424 - protein, 723 aa, Eucalyptus sp.; identical to SEQ ID NO: 862

SEQ ID NO: 2425 - protein, 188 aa, Eucalyptus sp.
MVLMNQISYPQMAGMIPSRLPLPFDTTQEEPVYVNAKQYHGILRRRQYRAKLGAENKLIKDRKPYLHESRHHHAVRRPRGSGGRFLSKDQKESKFTSLNDESNVKSTARVSSAIDLPNSEVCQLKDHRDTGSTTSCSKTTQTTTSSDAIPVSKFRFFGQPWHVMTTCDPSCDVRYSGDIRHLSLPGER

SEQ ID NO: 2426 - protein, 495 aa, Eucalyptus sp.
MASPGSRTPAGERAVVPCDFCTDRPAVLYCRSDAAKLCLLCDRHVHSANLLSRKHLRSQICDNCGAAPASDRCSTDKLDLCQDCDWDAHAASPVASSHHRARIDGFSGCPSPLDLASLWGLDLADGGKKSSAIARNDGGQLMQEVISSMEGWAYGAGANGFGFQDLMVPNDAGLAAPYPGAVKQGSTAGRTSCGRRKQEMHRQLVELLNGDFEDNSDGGGGAGGGGSGEGGDNLVPRTPNRTAAAWPENGEGICGEQRHGSDGVDAVVVDHHQPFQQQPTFTSLLMFPTQRDLEESGRGVVGAGTSNVGGQSTQVRISIVFSLGFTIWDFNLGRLRSQEEASAVEVGYGQNSEGFMIKSYNELMKDTSITTTKMLGDVYQLNGYVMPATSESNNLPVSGPSSGSALAKAKGSTDSKGYNFVDQTLITYGNDMKTMVKTKADLELLAQNRGNAMLRYKEKKKNRRYDKHIRYESRKARADTRKRVKGRFVKASEAP

SEQ ID NO: 2427 - protein, 191 aa, Eucalyptus sp.
MATFSGTTQKCKACEKTVYFVEQLTADNKVYHRTCFRCHHCKGTLKLSNYSSFEGVLYCKPHFDQLFKMTGSLNKSFEGTPRTVNKSDQVQTNSKVSRFFSGTQEKCVACKKTVYPIEKVAVDGTSYHKACFRCSHGGCVISPSNYITHLNRLYCKHHHNQLFKVKGNFSQLDKHAKIEEVPKLPVAEVAE

SEQ ID NO: 2428 - protein, 497 aa, Eucalyptus sp.
MFGEDKAQSTASASGQEDETNALQKVEATAENNATSNQSSGYMACVERDKELIEKGSDAQSSCTKPDLEAEVTEIEQVPDFSRPGWDKSSVNDNKVAMPEEKMKSTQEGLVLQEDADVAMVDAHRSSHALTQIKDARSEVHRGDENAASDWCGDNDGIMNSYRQAINLIGAFENNSHVCYVDRPSNYGMRQSDLSTHLDLSLKRSDPSAFGNHEERQTLKHSDASAFSRYVNKSSQPLRPQSINVPIRQMARGSNPDKEALHVADDSKPDTPVPVQSTPMSMIASGSTQSRQSEYFLSCPPQSGFPAPIPVRGVRFDNLSTDYGSVFPRVHCGQSVPSPVPSPSTAGQQDAFFLTESLHQSSCENNNCDRAQNPLDQNTSNSSNQSRYKQEFKFDSLEDRGHISPGTDRSATSSFCNGTLTRLSSLDCGSISGSNGNINQVSATRHAGESIGGDSLVAQDGSSRRATQREAALAKFRMKRKDRCYEKKVNTFTLVLF

SEQ ID NO: 2429 - protein, 240 aa, Eucalyptus sp.
MGLQNHQKMNLVLSTDAKPRLKWTPELHHRFVEAVMQLGGADKATPKSLMRAMGIPGLTLYHLKSHLQKYRLGKSQQSESCIDTKQEGEFYATENKEVQGADEYQNTEIIDPSTFQMNESLQIAQALQMQMEVQRKLHEQIEVQKHLQLRIEAQGKYLQSVLRKAQETLARYNNSPVGIDAAKAELSQLVSMVSSGCPGSPFSELTELGSSDLNDAARKQLKGICSVESSLTSSESSGSK

SEQ ID NO: 2430 - protein, 146 aa, Eucalyptus sp.
MSSREQRRAALYEKLQQLRAVTNSSAVNKTSIIVDAAKYIEEMKEKIDKLNEELGTSTDQDLPMVCVESLERGFRINVYSEKNCPGLLVSILEAFEELGLNVLDARVSCADNFHLEAVGGEVRNRKIPNLSVFIYSCPNFSVFIYS

SEQ ID NO: 2431 - protein, 277 aa, Eucalyptus sp.
ETSPSSSSLTTTTAPAPAAAAAAATTSSSSYSSAVAVAATTATTSSSSTSSTGSDPALEPSKRSEDCTSQKGPGKSPSPGAHPEEPAGKRHKAGGSGEHPTYRGVRMRNWGKWVSEIREPRKKSRIWLGTYPTAEMAARAHDVAALAIKGSSAVLNFPELAPELPRPASTSPKDIQEAAAKAAASFAPLPSERGAEDDGTGANPRRDTSERSLSDTNSSQESTNCSSNDNEDALFDLPDLCVDQPNGFGFCPSLSWQVCAADSGSRLEEPYLAWDYF

SEQ ID NO: 2432 - protein, 382 aa, Eucalyptus sp.; identical to SEQ ID NO: 2112

SEQ ID NO: 2433 - protein, 604 aa, Eucalyptus sp.
MDAPSALGPHAPRRSSDAADDRGRTGCLRNSGPQDPGGRGARYKLMSPAKLPISRSACVAVPPGLSPTSFLESPVLLSNMKVVPSPTTGSFLERRMLHGSVSSTTGLTNNHPCRPDRFGEKESGIFEFQPSPGPNPGTAEVNQKNKESMQVHSHSQTQSLALVPFVKSELAVPSSELSLSSPAKLVPSVANPPDEVDSEESNQQDHPGTGMQATQSDHKGNVMAERLTDDGYNWRKYGQKHVKGSVFPRSYYKCTHPNCEVKKLFERSPDGHITEIIYKGTHDHPKPLPNRRVAGGIILHIQGDRSADVSPLTGETSSNVYCQTSNIIEPKSTTQLYLAAGNEDSVEGTASLSYRIRDEVDEDDPFSKRSLLNRRLDIGGLDVTPVIKPIREPRVVVQTLSEVDILDDGYRWRKYGQKVVRGNPNPRSYYKCTNAGCPVRKHVERASNDPKAVITTYEGKHNHDVPTARTSSHDMAAPIAPAGPSRIGPEERETISLDLGVGISSAAEARFPNLQGSRHTIHQQLVQNQIHSNNSSIKVLRATPVSSYYRVENCGATTYCSTTEDLRGGRGLDVSPRNHSYSYQQTVGRVITGPYACSPQNQSK

SEQ ID NO: 2434 - protein, 123 aa, Eucalyptus sp.
MEGVSGNGVANPQLLDLMPNKREWHVMIDGAKARGSSEEKKLELRLGPPGTDDWCNLKQDMNNKRRDEALLPFGHFPSMASTQIATNNGGHQARKFGSSEALASPWPGTSYKENCQKLQTKRR

SEQ ID NO: 2435 - protein, 440 aa, Eucalyptus sp.
MAIKTARSTVGWQQNSAAHYKAPTSRRRVCTYWLAGKCNRNPCRFSHDASLPGNVYHRAAKQSSHMAEDCPGRKGPESSPVNSASSTSGERSESSTNKNPLKPQEKLCNHWITGNCVKGDACPFLHSWFHGVDFAMLAKLEGHKKGVSGIALPSGSTKLYSGSKDGTARIWDCHTGQCDQVINLGGEVGCFTCEGPWVFVGLPNTVKAYNIQNGASYNISGPVGQVHALEVANDMLFAGAQDGTILVWKGGSEADPFEMAAPLRGHTQGVVSLIVGRNWLYSGSIDQTIRVWDLHTLECVQELVGHTDMVMSLLCWDQYLISCSLDKTIKVWGVATEGGSLEVVYTHHEDHGILALSRTIDAHGKPVLLCACLDNTVRLYELPSFTGRGKIFSRREVRTLQTAPGGLFFTGDAAGTLTVWNWLDSPKSQTEQLPQSMESC

SEQ ID NO: 2436 - protein, 249 aa, Eucalyptus sp.
MGRGKIEIKRIENANSRQVTFSKRRSGLLKKAQELSILCDAEVAVIIFSNTGKLYEFSSSGMKQILSRYNRCQDSPESTVVEYKPESTKEDDKVVDTLKDEIAELQMRQLRLLGKDLNGLSIKELQHLEQQLSGALSSVKEKKEQWLLEQLERSRLQRAMLENETLRRQVDELRGFLPSTHQLEYNPEKRRKALNNSGSGSPDKTCNRTAENGDSDTTLYLGLPFDVYHKRSMSDKENYNSKGNQKGLP

SEQ ID NO: 2437 - protein, 295 aa, Eucalyptus sp.
MAAATEPSQEVFSWLKNLPLAPEYHPTLAEFQDPIAYIFKIEKEASKYGICKIVPPVPPGPKKSAITNLNRSLAARASSSERPNSKSSPTFTTRQQQIGFCPRKPCPVKKPVWQSGENYTFLDFETKAKSFERVYLRKFYKKGSPSALEIETLYWKAAVDKPFSVEYANDIPGSAFPPIRSKKGRETGEGMLTVGETNWNMRGVSRSKGSLLRFMKEEIPGVTSPMVYVAMMFSWFAWHVEDHDLHSLNYLHMGAGKTWYGVPRDAAVAFEEVVRVQGYGGEVNPLSESMSWPKS

SEQ ID NO: 2438 - protein, 772 aa, Eucalyptus sp.
MPAGIMIPARNMSSSPMIGSNGNASGYGSSSGLTLGQPNMMESLHHHQLHHPLDMVHQTPSESELARLRDEEFEISTKSGSENQEGQSGDDMQDLQRPNKKKRYHRHTQHQIQEMEAFFKECPHPDDKQRKELSRQLGLEPLQVKFWFQNKRTQMKTQHERGENTQLRAENDKLRADNMRYREALSNATCPNCGGPTAIGEMSFDEHHLRLENARLREEIDRISAIAAKYVGKPVVNYPLLSPSAPPRPLDLGVGGFGGQSSVGGEIYGAGDLLKSIGAPTEADKPMIIELAVAAMEELIRMAQMGEPLWSESLDGNSSGVLNEDEYMKTFPRGIGPKPAGFNTEASRESAVVIMDHINLVEILMDVNQWSTVFSSIVSRAATLEVLSTGVAGNYNGALQVMTAEFQVPTPLVPTREVYFVRYCKQHGDGAWAVVDVSLDNVRPSPIVRCRRRPSGCVIQEMPNGYSKVTWVENVEVDDRGVHSLYKQLVNSGHALGAKRWVATLDRQCERLASAMATNIPNTDVGVITSQEGRKSMLKLAERMVISFCAGVSASTAHTWTTLSGTGADDVRVMTRKSIDDPGRPPGIVLSAATSFWLPVLPNRVFDFLRDENSRSEWDILSNGGVVQEMAHIANGRDTGNCVSLLRVNSANSSQSNMLILQESCTDSAGSFVIYAPVDIVAMNVVLNGGDPDYVALLPSGFAILPDGSAMQGGNDQQGVGSGGGSLLTVAFQILVDSVPTAKLSLGSVATVNNLIACTVERIRASLSCESA

SEQ ID NO: 2439 - protein, 544 aa, Eucalyptus sp.
MVSWQIFCAKCGSKDLTADNDIILCDGACDRGFHQYCLEPPLHAEDVPPADQGWLCPGCDCRVDCIDLLNESQGANLSIADSWEKVFPEVATADKTEDPNLGLPSDDSDDADYDPDAPQVDEDLGDDSSSEDQGNDSSSDESGCNVASDKSGASLKYDRIGLSSDDSEDDDFDPDAPDSEKVKEEGSSSDFTSDSEDLAAAVGGVADEVNSYRGGGRRSSRNSFEKKEIVKGELQSLLEGDADKDVSVCMPGKRHVERLDYKKLYDEEFGGKSSDSSDDEDWSDTAEPSKRKRGADKVALASNNGNFTSGEIIEHNKNGNEQTPRRRTNNRMDSPSTNSITAIPRRSSSAPESTGRKARSTYRRLGEAVTQRLHEAFKENQYPERAASEKLAGELGITTQQVKKWFENARWSFNHPSGSKVRVSAKDMIMENPRPQLSTGPHSSAPEMITDDAPSNGIPNAEPSGVASMPECIDKDVKNSGVGGPQMNRKSYDSSHLGKRKEKADNVVFGPDQVNQTQALQDDSAKASEPQTSSRRHTRSKSKT

SEQ ID NO: 2440 - protein, 283 aa, Eucalyptus sp.
MANSPFLLSVIPFLFLFHIGVGPELSKSQDEDAGGLVGIPSLPAMPKKSGIPVRSTTSGSSRDLSDDDEIGETATTDHLGPLDAKRVRRMLSNRESARRSRRRKQAHLSELETQVAQLRVENSTLLKRLSDISQKYNVAAVDNRVLKADVETLRAKVKMAEETVKRVTGLNPMLHVMSDMSSVGVPPFDGSPSDTSADAAVPVRDDPKHQFYQTNSSNPASSADDMRTNNGLADIPAAENAQQNGAAKIGRTASMQRVASLEHLQKRIRGDSSPRGPPYDGEQ

SEQ ID NO: 2441 - protein, 433 aa, Eucalyptus sp.
MNTPSSLPEMLHCADMTVLERQRARVKWQQDPLQLHAQSEGQRYYYGGGGELNGAFGLGQSIESLLGGGGGGVVFGDVPNHQIKPDPGVESGWLSSFDLSGLAYGACGFGGGTGLDANFAINRTLSCPPAVVAAAVSPAATPAVTVEKGKESAVSEKMTQAGRESSKKRKTDKVHNTKIEDDSKGKRIKGCPEEGESKIMVQSNSNNNKEASASTSKENSKVSDVPKPDYIHVRARRGQATDSHSLAERVRREKISERMKFLQDLVPGCNKITGKAGMLDEIINYVQSLQRQVEFLSMKLAAVNPRLDLDLDNIFAKEMNPACTASFPTIDMLSDITNPAYLPFSPTQTVASCSGMEIGINPDSGLRRTISAPLSIPDTFVDSSCFSQSQQPLTWDLGLQNLYNMEFHQGKAMAFPCQQFTGSVEGGNLKMEM

SEQ ID NO: 2442 - protein, 350 aa, Eucalyptus sp.
MEKDASPQSDPTITTSSTSPEQPPPPPPPHAPHSPPPAQSSSSPLNQQFAANFSALYHSIFPPNSPHSSSALITPSLCSSASSDSNQNATARSTIAIEHRLNQARLVLEYQQLRDHYDLCRAHLNDLTEEIDSLRRENARLRLANSELVKLLNLPSQGTLQSCFRRLGLSDTNATGSDFSSEDVCSYSPTSVMDQSGYETSNPERVWLPKSISVRSSGYLKLNQPAASNSRSSRPVSQLRSPRAQEPPKVQQRVYVPGGKKEQEALEFEVYSQGMFKTELCNKWQETGACPYGDHCQFAHGIAELRPVIRHPRYKTEVCRMVLAGDMCPYGHRCHFRHSLTEQEMMLASR

SEQ ID NO: 2443 - protein, 191 aa, Pinus radiata; identical to SEQ ID NO: 2252

SEQ ID NO: 2444 - protein, 277 aa, Pinus radiata
IGSGNYQQTFVDPENYTKSHRSSPTRFDNPYNPRTVEEVFKDFKSRRNGLIKALTTDVEEFYQQCDPDKENLCLYGFPNESWEVNLPAEEVPPELPEPALGINFARDGMQEKDWLSLVAVHSDAWLLSVAFYFGARFGFDKNDRRRLFHMINDLPTIFESVTGIGKRPTKEKPAVTNNSSSKNKQSGKMRASEPPMKMSKTPPPRDEDDSLDEEDEDEHGETLCGACGDNYASDEFWICCDMCERWFHGKCVKITPARAEHIKQYKCPSCTNKRPRT

SEQ ID NO: 2445 - protein, 744 aa, Pinus radiata
METNNWRNEESRRKIVNMITDTLQRHMPQTGADGMNELKKIALRFEEKIYTVAMNQQDYLRRISLKMLSLESKVNEHSNHFPGSSAGNNQQPLDPGGMMLRPQTRNQQQAPGNSLPLTGQPEPQHPVLQQNRQNSISASAMPNSAGLAPPLSPVPNGLPTMQGIPHNLMNSSTGQSSEQQRWQHQIFQHQLQQQQHAILNKQLQQQSQIQPLILQQQQSALPQSQFQPSQQYILQPAQQPTLPSTQPSILSQSQTSIVQPGQQSFHQSTQQSALQQASQSSLQQHQHSILRKQQLQQSVIQQQQQSLMVQQSNLQPQQQHQQLLGQQNMQLQHQIQQLLQSKHQQTQETSSSSLQSESQQLQEQSQQQQLLSQLQSQIQPFQQQQQLFQQSNPIQQELRRLQTTGGLLQQASSIEEQRQLLHQRGLSEDSSSFPASTESSGRKGHPTVADWQENVYQRLQNLKNIYYPDIKELSTKLSTTCQQPMQPDQLEKLKHYQTTLHRMMAFFEVQKSSIPPGFKEDKVDAFEKQIQAILNSFSGQKGHPIVADWQENVYQRLQNLKNIYYPDIKELSTKLSTKCQQPMQPDQLEKLKHYQITLHRMMAYFEVQKSSIPPGFKDDKVDAFEKQIQAILNSFSGQKDHPTVADWQENVYQRLQNLKNIYYPDIKELSTKLSTKCQQPMQPDQLENLNHYQTTLHRMMAYFEVQKSSIPPGFKEDKVDAFEKQIQTILNSFRQGKAALQRQQ

SEQ ID NO: 2446 - protein, 593 aa, Pinus radiata
MAESEECNGGYESLLDWLDIGDESSSMDPFINGDSCPIADQEHEDFWEAALPTMDIQSETQFVMEPSFSSNDSVAPAAQKGDAESFWVEPPVNDVEDSPKITKKRKRARVSGESTKGKLWNVFENNAASPHTGESLDHGNHCLAPETKLSSLHGAESDNQLDLEATRNNSNNNNNNSSNSNNKGRSGGRQSSPPNLPKESRWAEQLLNPCAVAIANNNIVRIQHLIWVLHDLASISGDANHRLAAHGLRAFTAKIMHPGASLPCSEFLSADPKLFHKALIKFHEVSPWYQLLYTIANKYLLEAFEDQNSKALHVIDIGVSHGIQWPTFMEALARRPAGPPSLLRLTIIADTLGAPFSAGPPSNDFPNRLKRYAKTLNLDMEVNVIAQPLDSLTREALGVKEDEALAICGQFRLHQLLGEGLDKNEGKDNQLTSVSPRDKFIKFIKDLNPLVFFLSDNDIDHSSPDFIERFKNSVDHLWRFLDSTSVCFKGRECEERRMVEDEAAMGLVNNVAYDGASRVERNQNHLNWANRVREEGFVCEIPSDKIVDCARAMLRKHDSNWEMRLEDGCISLCWKSHPVTFCSLWKPCFNEPT

SEQ ID NO: 2447 - skipped

SEQ ID NO: 2448 - protein, 227 aa, Pinus radiata
MLWPYIPAHYSITCGQDLKTKVQSVLLLLGGREIPPGLSGMPIHGHHHQKVLADIPQRLNQPQRIASLTRFREKRKDRCFDKKIRYSVRKEVALRMQRNKGQFTSTKSNSEDLGSSAAKWDPSQGWHPDSNGNQQEVVCLHCGIGERSTPMMRRGPAGPRSLCNACGLMWANKGVLRDLSKNPSSLGSQNQPSSSHEQNDGRGGSHEVEVGDRNHSVTVPTNEHISS

SEQ ID NO: 2449 - skipped

SEQ ID NO: 2450 - protein, 350 aa, Pinus radiata
MGNSSQPPGFCFHPTDEELFTHYLKRKVYGRPQPCSVISEADPYECEPWDLPDNSCLKGRNLKGYFFSPKKAEYPIGSRKVRATKLGYWKVTRKDRTIVASSEVLGIKKTLVFYRGRVRHGERTNWRMHEYILDDCNDSNSNTMQQSYVLCKVFQKNISRRCKHCSASSSQVNKTEYPDGEHGEMASLNIQNVAQATNDFKTPNGMLLGQGSVLNDVLARRGHSEVPDNDEFHMFLMTHIGDPDDPQLDKEENGPMEQAAFANQPQQFVDTNLENVTSGDEQNPMQDGIKDDVDNLHFQDTMIPEEDKSKFCSSLSAQHDLSLDILDGDFIELNDLITPLEVDSLSSEFE

SEQ ID NO: 2451-2452 - skipped (2 entries)

SEQ ID NO: 2453 - protein, 320 aa, Pinus radiata
MDESNNARRHHHHSGGGAAEVVAGGNTGGGGGATNGLSLSLPLPPPGSSSVKLNASPPPPPLPPPQTAGEPAGGDRVAAGGGRDDIWSQTATLTLIDAWGERYLELNRGNLKQKHWKEVAEAVNGRPGNNKQAKTDVQCKNRLDTLKKKYKVERSKIFSGSVTKWPLYTKMDELIGPARKHHHHPQPLPLPQPPTLRPRRHLIESSPNPLNTATSPDMTESCLNGFNGNPSSAKRRKTAAAAVENPDGSPLKELAGAILKFGEVYERTEVVKHQQMMDLEKHRMEFAKDLELQRMQLFVQTQLELAKIKHAKHGNTEHYL

SEQ ID NO: 2454 - protein, 221 aa, Pinus radiata
MHHKTHYTDDAAEKRLGEQFLNNSTPGNCRAGHNKKIPCRCPVCRRTFVGLYELRRHFGRKHSEGEKMYGCRKCGKRFYIEVDLRDHEKLCGEPIECKCGMKFAFKCNLVAHKKTHAECQDSSHSPPPQPPLPNEDSCSSSSSSSYKQIQSHPTSLAVASVAAFSEDTSSASASSPSPSSSSSAAASSVALMVSCGVKLEDISGFPRVMTPRTLLGQEPRN

SEQ ID NO: 2455 - protein, 541 aa, Pinus radiata
MHYPGSSYYQAEQPNNNNPSYNWASAPPYGEAAAPAYYPPAPEPVVAPTHGSDPSNYSYNLPQTIPASYPNQFPQYPPPNASQFTPQSPIISPPPPATNANYLYSSSPTAPVYHSATAAQNPAYDQGFAYPDHRGYETRDSFQYPGFDQKYYETPVGKDPGYDRSGFDVDDGGFGGEVYAYDGGRTEPYGARGTGTGSGSGTGAGSKPLAAFDDYGNLTKITKAVPKAETQDGGNGVQKFRVKILPDSGSQTNMDVLCQIGLDGLRMLDPSTNRTLKIYPLETITKWEVNDPSVYNFWAKSSVDLEPRRIRLQSNRYTTSTILDTVAAACVQLREMVDDKSSGNNSDTNKTSDQLTEKRRSSLADWVTLKRPVEEKQHWVPDEAVTSCKGCGTDFGAFIRRHHCRNCGDIFCDKCTQGRAALTADKDAQPVRVCDRCLAEVTQRLTSTKETSSKATAQRSHDDLAKRLMEEMGRNRKGSSDIGSGSSPLWSSQSTSDGTGKRMREVACPTCTVHLQVQVPSSGTETVECGVCQHPFLVSAR

SEQ ID NO: 2456 - protein, 335 aa, Pinus radiata
MDVQITIQYYLIVELIILFGLTGRWSLIAGRLPGRTDNEVKNYWNTHLSKKLTMSSQNPIFPMTAPADPEQTASSESSEEDVVRSADYRVIHHSGMRLAPAKIGGTSISAGVPAPVSSDEVINMKSWKQLLEDSLMSDFDDSEDDTSLMGIELSDDVLGSEAPLMEIQTNVSCSTSGPNEPVHSHGHLLADATSNQRSSESNVLYSQDCNVLSLPPTDNTLDFRIQDFSLESLLLPSVYNFDEICPVQSQLNSSDHVSCFAVAAEQAMTDIYNNTLEPDWLTPVEYEKQSTQSDQMNLLGNFFLSEENWEEEVPPSLSKIQEEEYRDILVDISNK

SEQ ID NO: 2457 - protein, 756 aa, Pinus radiata
MNSISEMTTVQSLQHSSMSTASSFPSESSGGFDEKSGFNQKSRFPDRFPAGLRVLVVDDDPICLKIIEKMLRRCLYEVTTCSHATVALSMLRERKGSFDLVISDVYMPDMDGFKLLEHVGLEMDLPVIMMSADGETSVVMKGIKHGACDYLLKPIRIEELKNIWQHVIRKKRNLGRELEHSGSAEDSDKNKKGSDDIEYASSVNEGTESNSKTSKRRKETKEEDDDFEQENDDPMSLKKPRVVWSVELHQQFVNSVNQLGIDKAVPKRILEMMNVHGLTRENVASHLQKYRLYLRRLSEVAQQQSGLNSSFGGTAEVNLGSMSALGRLDLQAFAASGQTSPQTLVAMQAEFLGKINAKNGLGISGETFCLPTAFHGVNSNSLNSLGFGQQLMNNQGGVLQGFPSGLKLKQLSLSQSQPNISPYENGVFSMNDTSPGLPFLPQLSTAAVALRDLDHIYGSNNNLGLDLHDKALMLKLLQQQQLHQTPGPLPHQSGAQLHGQQVLNLPSSSILGQQTLSNTLSTLGNANSNQGNSLIGPGSAQKNLITPEGHDLTLHACNAYFGIQRMEDVNQSLNSMPVNSVFQPRTVASTPLSSGAEGVIRLPGMNIPRETPEVFNSQGLRSSGVNCNALNGFAPGLTQGNVLGCKVPKAAFNQGLGPMVIPTLNPHFSQTSSGLQGLNPGIQDHVLSQSLGFSGRGSNLPNRFTSNDGHLRTISNTPRQSDQSRADTGTRLKDRVSDLMEGTRLAEGEFSLDGYN

SEQ ID NO: 2458 - skipped

SEQ ID NO: 2459 - protein, 339 aa, Pinus radiata
MERPMTFLASNPQLPPGFRFHPTDEELILHYLKKKASSSPLPVPIVAEIDLYKFDPWELKASFGEREWYFFSPRDRKYPNGARPNRAAGSGYWKATGTDKPIVISESTTIPVGVKKALVFYRGRPPKGIKTSWIMHEYRLTDSGTSTTGHRKGSIQLDDWVLCRIYKKKNTNPRLAAAKERDEPETEDVLATLPDIEQDQKPVIPKVASFTGLLDGEYPFLSCFLTDNSDCTGLAGLPELESFHNNSHNNSKREEYMNNNSNNTPKQQSSTSLSSIDSKVLDSLKRTLSLGCMEDEPAPAKRPNINNYNNMPFFVNAFQPNQTYYQYPQKLMFNPMEDF

SEQ ID NO: 2460 - protein, 386 aa, Pinus radiata
MGRAPCCDKAGVKRGPWTPEEDKKLLAYIEQHGLGNWRSVPVNAGLQRCGKSCRLRWTNYLRPDIKRGKFSLQEEQTIIQLHALLGNRWSTIATHLPKRTDNEIKNYWNTHLRKRLLKMGIDPVTHKSTFDPLNLNDGQKSKEFRALSHKKQWENARLEAEARHRETNLNPRASRGLWMTGNNNGSDVLNMIMLHGNNTRSTMSSASTNNSSHIDHLIESPTSSLSFVESSDMLPLFHHSIPLSHQESFCEYLQKKPLCEHFTGIDINNDNKTDGGSNLGDPNLLIPSSFHDPIFSDKHCNYSSTHSISNEISSHGDLGSEISSHVDLNTDLLQQYLSEGPSCEPAVCSELAPEDQSSIANLGSGKDYWNDILKMVNSSSSVDNIF

SEQ ID NO: 2461 - protein, 659 aa, Pinus radiata
MMMNGAGRFEHKTTTGIDLSVKLEEDDDGGRSVQENGSHGGAEKDNGYDNRTAEKDFFHHEVGRLSFRLLPVDGESKAEDGTADMMSQGPEDEDDKPATNVSTGLRLVNVQAARNAASDRSTVEMEDCASPINSQETSNPNDMDGEPNSELVVVQKELNRMNEENQRLRFMLNQINSSYNNLQLQLASLMKQQPQNYGHAVREQVHKEEKLNIFRGITGNNNGEAADDQTQTPIQRQFLEIKDLSRLNSGTIAHEDSHTSEARRTLTHAENDQEESKALMAFNHIDNKRARDHDSHGLTSKGHDSPDRTPSPNPSPTHHENVGTPQREGSLDRRSSPGWVPNKMQKIVDQTDATIRKARVSVRARTESPMISDGCQWRKYGQKMAKGNPCPRAYYRCTMSPCCPVRKQVQRLAEDRSILITTYEGSHNHMLPPAATAMASTTAAAASMLLSGSSTSADNIALNASFMAGALMQHPCNTSTASISASAPFPTITLDLTHNPNQMANAPGHMAASNPRALAGLPAHAMPFVGMPHQFPTNTPQGALFHGQSIYNAPSMFAPLAGQLQRPQQPMMPTPPKLNIQAGQPPTPQQQQPSFIDTVSAATAAITSDPNFTAALAAAITSLINNNNNAANAISKPNSSQALNPSPQVAAHVKSDHTQ

SEQ ID NO: 2462 - protein, 196 aa, Pinus radiata
MDVAGGASNSINMEMWNMLELIRHHLLEVEDDIDNQGTSPFSFSSTANAGSVYINIDDIENEGTSPLIRRAEVFKVKQQPCEQENGKMKQISYRHYIGVRRRPWGKFAAEIRDPVKKGARVWLGTFNTGEEAALAYDRAAYRLRGAKALLNFPLALASNSESGLAVGQRAHRRKRGNSGSGRGMDIELEEPSSNFS

SEQ ID NO: 2463 - protein, 409 aa, Pinus radiata
MNVVESVARQSRIETTQSPKSNPSSTSNVVDFCKFMRKPHYNYAVDIFNPIVTDHELYQVGSGIEHCQDNSNGTESLPWPCPSFGGLEDNINEQQSVNFQVGNHGDLKPMAVSCQLTPSEIQFQLMKGQQGEIEQLQWLTSVVSAPKQKSGQWRDATDSLGLRPWPMKHACKQGLRLCSNQPTKLYRGVRQRHWGKWVAEIRLPRDRKRLWLGTFERAEEAALAYDRAAYRLRGEHARLNFPGLKHQQQLRHGSHNLSPSSASNPHSITAISNQSGQLSVLQSAVDAKLQAICERLSASIKPSHEGKLGHNCLDQKNITVTHCKEKSVLEVKSECPEFSGGDNNSVLTAQNSDSVPLCKSMTDAVCNMPSISASASAVATMWADMDGVDALNRMPSLDMDMTWDVLESE

SEQ ID NO: 2464 - protein, 196 aa, Pinus radiata
MVRSPCCDKVHTNNKGAWTKEEDERLIAHIEAHGEGSWRSLPKAAGLLRCGKSCRLRWINYLRPDLKRGSFSEEEDDLIIKLHSLLGNKWSLIAGRLPGRTDNEIKNYWNTHMKRKLLSRGLDPQSHRPLGLPCKTSLISRPVPEQEIRTFQSPETVEVEDFFQNDRPVSSAIELADSDAKERPDLNLDLRIWHLQ

SEQ ID NO: 2465 - protein, 67 aa, Pinus radiata
MQKCNLIIPKGHQLQIKTHFLSFEIVIQSLTFLVSETLILMIVMWSIQLALIQLEYTVATCGVYGLS

SEQ ID NO: 2466 - protein, 161 aa, Pinus radiata
MRKWGKWVSEIRMPKSHEKIWLGSYNTAEQAARAYDAAVYCLRGPAAKLNFPETVPGIPSASSLSRQQIQHAATRYALGEIPLISPSLQNIDSREKPASSSRSSCNSETDLLSNSEKFSKELDFDLWESMFSGQDCLSLDQLPPIDEASALELIPPWQKQQ

SEQ ID NO: 2467 - protein, 880 aa, Pinus radiata
MHNKEVVRPKNMQVRPDAEGNNRLAEMNRHGRQDQKEARGGIMGDGQELSEQDESRDDDGMIDVGDGDWHLADANSLSRRLPHQQPPQPQGSVIRWERFLPQRCLKVLLVENDDSTRQVVSALLRNCSYEVVAVANGQQAWKLLEDPSNHFDIVLTEVVMPYLSGIGLLCKIMSRSNSKNIPVIMMSSHDSMGTVFKCLSKGAVDFLVKPVRKNELKNLWQHVWRRCQSSSDSGGETGSQSQKDTRPNGTADPDNNTGSNDESDDASIGLNNRDGSDNGSGTQVSWTKRVVEVESPQHRTEWGLSQPHSSAVGQVIQQKVETAQNGWMQMAVTSGECQDKKPLDYAMGQDLEIAVPRQTDAELEHQQEEKALYAQTFGREENARLANSVEGVEISEGPVESGDSPSSEGAANKAADLIGVIANKPNCGNSKLEDNKSGEDLDNDKIGTDFKHLFLELTLKRPRQNGKEDGEPEDRHVLRQSGVSAFSRYNTGGCQFSNPSGDTVPPNSLPKGYIPSVSLESEKTGPLHAAVGVERVASSKGSGGPDQSTPALMHNQLSQSSNNQDLGSSVVGPSGQDMFPVPKPISDETVSVPNACRQVGKPMSIHPCRAVPYDTVAAPRVYGSAIHPLYYSHTGASSLWSPEAQHIADRGDVCNNSNNGQIEQQLVLPRNHQTQVHHHHHHHVQHVHYHEHHHQTHQHKHNHTHTHDHPKQDEQTKKNFSITPPLCGSSNMPGNDAPDGNNGQSGSNNGYGSSGNGNGSANGSASGSNNGSNGQNGYSNGQNSAAVTPAGTNGESDTGIGAVKSSTGGASGTGSGSGVDINRSAQREAALTKFRQKRKERCFEKKVRYQSRKKLAEQRPRVRGQFVRQTAHETANGEVD

SEQ ID NO: 2468 - protein, 463 aa, Pinus radiata
MQTGRAENRSWNSDQPKPINLMAPSQLVQGPPASALARNSAGFFDSLGLPGQDQFLDPCSMWRLGCNSDHTALHEQLHGVMEKSGQFAHGCYFVKAEEELDFFPARMGLNLAGAGTATAYSSGGSQESGHGNRFCRTGISSCAGSQIPHCQAEGCKANLSSAKHYHRRHKVCELHSKASTVIVGGFIQRFCQQCSRFHPRSEFDEGKRSCRKRLADHNRRRRKPQPSTCVTSQSQAGTTGLENDNQTTKGSSGHITTAVQNTPNISRSTSSTSPSLITSVPMMMFPNNYKGHSPVLKGTSTDKNSCVEFLYASIAKTGADSSREGRIISDNQIESSEYKLVQPCSSQLRPGFLASEIAGRFSRPAPVDIQYSQSLISMKNNNSNPRVTEPSKSLLNLRIFSTSSNDVPATLSSMKNGASNWILNGSSAESVGTYDKIHETAESPRSAYDPAPRNDAVIKWDEV

SEQ ID NO: 2469 - protein, 430 aa, Pinus radiata
MNMERLNTAAAQASSSLYGVNMAEYGDAGVSSMMGLITQHEPEQSENIMSTRIPSSFSSFHGHADCLLSAAMFQGSQGDHKLNPQPGMNQQLVSEQSIMSDSSMPFVRQSLLWSRNQFEFRRNNRNANRSVLKYSAKPIVTSLASQARGEARMIPSLDANSAHFNVDNEEHAIKSKILAHPQYPSLLGAYIDCQKIGAPPEAVARLDALTREHQDPQRRTVSIGMDPELDQFMEAYCEILTKYHEELAKPFKEAMLFLKKIETQFNSLGKETIRISSPADDDEKTEGGGSSEEVEDGSGGETDFQEVDHHAVEDRELKNHLLRKYSGYLSSLKQEFMKKKKKGKLPKDARQKLLDWWSLHDKWPYPSETEKIALAECTGLDQKQINNWFINQRKRHWKPSEDMHFMVMNSHSPHSAALYVERHMMTEGYL

SEQ ID NO: 2470 - protein, 406 aa, Pinus radiata
MATEEESGSKCPKDLRRYCCKTCGITRSKRILLKLHIISSHGREALENDEGFASEVKGQSHRRSACVCQDCGASFNKPAHLEQHKLSHSGEGGQSIHGLVPSAFYSLTLHHYRTCLLQSQRTFVCPVDGCFCSYKRQDHLNRHMIKHEGKLFVCPKEDCKLQLSTMSNLKRHMERHRERGESWKSLNLQSREVKKYPCPKPCCGKVFKNPSRLVRHLDDVHSTSYVQVVCCEPGCLKYFTNVKALKEHVQQNHSRVCCEVCGSQQLKKQIKRHMRIHESQTCGERIKCHFDNCLHSFTKKSNLNKHIRAVHLGLRPFKCRFRECEMSFAHKSVRDNHEKTGRHCYVQGDFLEEDADFQSRPRGGRKRKAFTINTLLKKRVACPDRSSTVLDSGSSFLDWLISSGRE

SEQ ID NO: 2471 - skipped

SEQ ID NO: 2472 - DNA, 60 bp, Eucalyptus sp.
attaatgttcgtactggtgaactgcaatctagtaccacagacaaccatttcgatagcgac

SEQ ID NO: 2473 - DNA, 60 bp, Eucalyptus sp.
tatggatgtttgtactgtaagaaatgttttaccctaatagtagtttacaatatatgagct

SEQ ID NO: 2474 - DNA, 60 bp, Eucalyptus sp.
tgaagttgtgacgggaaatgttaagcaagcaaaggaacaatctgctaatcaaaacagcaa

SEQ ID NO: 2475 - DNA, 60 bp, Eucalyptus sp.
caaggctctgaccactgatgttgaggaattctatcagcagtgcgatcctgagaaggagaa

SEQ ID NO: 2476 - DNA, 60 bp, Eucalyptus sp.
ttccttgactgctaattgtgtagttggtcactcttattagtttggtgttccttggttaga

SEQ ID NO: 2477 - DNA, 60 bp, Eucalyptus sp.
cttttactagcaccacattgaacctttattaggatatttaaattagacgttgggagctat

SEQ ID NO: 2478 - DNA, 60 bp, Eucalyptus sp.
tacaattttaatgtaatactctttagtttctatcgtcctgtgtcgtactgttaattacat

SEQ ID NO: 2479 - DNA, 60 bp, Eucalyptus sp.
gaaactgtagagcctctagttcttcgagcgtggatggaatttctatttgttaattgcaat

SEQ ID NO: 2480 - DNA, 60 bp, Eucalyptus sp.
tgggatatctccgtctcaccgatgctgggagctttaccataaacagtgacaatatagaca

SEQ ID NO: 2481 - DNA, 60 bp, Eucalyptus sp.
tcatcgtcgtcatcatcacaccccagtagccaccataattgaggaagtaagcaccaaccc

SEQ ID NO: 2482 - DNA, 60 bp, Eucalyptus sp.
atgctacgtgtacagtgctgtactatgccgctatttacgatgcctagtacttacgttaag

SEQ ID NO: 2483 - DNA, 60 bp, Eucalyptus sp.
atgatcctaatcgggagcaacgctaaatatactagagcttaactgcgaactgctcgcaaa

SEQ ID NO: 2484 - DNA, 60 bp, Eucalyptus sp.
ggatgatacagatgacaagaactgactttttagggtgtaaaaagacgtagcttttttgtt

SEQ ID NO: 2485 - DNA, 60 bp, Eucalyptus sp.
ttttggtctggttaatattggaatgacgcacagatccaagcgtgttgtgttaggcttgat

SEQ ID NO: 2486 - DNA, 60 bp, Eucalyptus sp.
aattagccgtcattattaccacctcaattccctgccaaaatagaaaatgaatgactgtgt

SEQ ID NO: 2487 - DNA, 60 bp, Eucalyptus sp.
tttaggtacctcgaccccaggctccctgaaagtgtgtttgtacatttaccagatgcagta

SEQ ID NO: 2488 - DNA, 60 bp, Eucalyptus sp.
tggtaaatctaatgtgttcttatgatattgtgtataaagtattgcgagaagtcgttatac

SEQ ID NO: 2489 - DNA, 60 bp, Eucalyptus sp.
tttttcctctctcccgatattctgcttgtattctcattgcggaaatggaatgaaaaagat

SEQ ID NO: 2490 - DNA, 60 bp, Eucalyptus sp.
aaggaaattaggcgaaagattagatcggaaaaaaggttcgattgatctgttgtttggtgt

SEQ ID NO: 2491 - DNA, 60 bp, Eucalyptus sp.
ttttactccagaaggcaattttatgagcgtttatatggatctgcaacagaatgaagatgc

SEQ ID NO: 2492 - DNA, 60 bp, Eucalyptus sp.
cttctaccttaattatatccatatgtcggaccctagttctcctaaggatgaggcccatgt

SEQ ID NO: 2493 - DNA, 60 bp, Eucalyptus sp.
aagggaaaggtggagacggaagcagacgacttctggaacacgttcaataacgacgagatg

SEQ ID NO: 2494 - DNA, 60 bp, Eucalyptus sp.
tttttatccatgtaatgaaatgttgaaatgggattgttcgggtaactagcgaaacaccaa

SEQ ID NO: 2495 - DNA, 60 bp, Eucalyptus sp.
ctctttctcaagatattaagtgagttggcctaagatattgacgtacccaagattggattt

SEQ ID NO: 2496 - DNA, 60 bp, Eucalyptus sp.
ctgcaatttcacaacgagtccgtcagtagtaggacctcattcacagctccagaaacccga

SEQ ID NO: 2497 - DNA, 60 bp, Eucalyptus sp.
agagaggggaaagtatctacgatcatttgagttaagtcttaattccttcgaagatgaggg

SEQ ID NO: 2498 - DNA, 60 bp, Eucalyptus sp.
ttgtcgcgtgtataactgttgtcattactgaccggacagacagcatgggtgataattgta

SEQ ID NO: 2499 - DNA, 60 bp, Eucalyptus sp.
ttctttttgtgaacaaagtacaacctcttaccttgtaataaaattgtgattactctcgtt

SEQ ID NO: 2500 - DNA, 60 bp, Eucalyptus sp.
gtggatgatgatatctggggctttggtgatatacccttatgcggattcgacaagaacaag

SEQ ID NO: 2501 - DNA, 60 bp, Eucalyptus sp.
atgcattattgagaagttttgtggaagccacacagtagatgcttgaagtgtggaatcttt

SEQ ID NO: 2502 - DNA, 60 bp, Eucalyptus sp.
tcattgtgattagctgtagctagctagcagggctgtaaaactaaaaagtctgcctcgtcc

SEQ ID NO: 2503 - DNA, 60 bp, Eucalyptus sp.
atataaaataaggccttttacaatttattcttaaaactaatatatttatacaggagttaa

SEQ ID NO: 2504 - DNA, 60 bp, Eucalyptus sp.
cttggcgttatttgcgaaagctaacttctataataggacccactatcaatcaacacttag

SEQ ID NO: 2505 - DNA, 60 bp, Eucalyptus sp.
tatctggctacacagtcaactggcctagtcatatggaaactattactgatccatgtacac

SEQ ID NO: 2506 - DNA, 60 bp, Eucalyptus sp.
aaaatgatagctacacagctaacctattgcgcaccatcttatataaattaagtgtgttat

SEQ ID NO: 2507 - DNA, 60 bp, Eucalyptus sp.
aatggaggtgtctgtcggttaggtgggatgacgttgagcctgatcgtggtagtaggattt

SEQ ID NO: 2508 - DNA, 60 bp, Eucalyptus sp.
ggtgtcacctgtctatggacgtgacaccctaaactgtcaggttgatttcgaacaatcccc

SEQ ID NO: 2509 - DNA, 60 bp, Eucalyptus sp.
agagtagtcgttgcctacctcttcatggtgtttggttactacttaagcgtgtcatccgct

SEQ ID NO: 2510 - DNA, 60 bp, Eucalyptus sp.
agagtcaagcgttcgtagatacatggggacgataacaggcattagtgatctggatcctgt

SEQ ID NO: 2511 - DNA, 60 bp, Eucalyptus sp.
tgctactaggaaattagtgattgcgacacgaggtatgctgggtattgtagacgttctact

SEQ ID NO: 2512 - DNA, 60 bp, Eucalyptus sp.
ttgatgggtagttactaacttaactgcttccttattaattataagggtaagtcctgttct

SEQ ID NO: 2513 - DNA, 60 bp, Eucalyptus sp.
acatgtgtacaagctattgagatttgcaaactatacaaaaaatagggtacagacacactg

SEQ ID NO: 2514 - DNA, 60 bp, Eucalyptus sp.
agcagagggccctggtatttacgtgaaagtaagtgttgatggagccccttatctcagaaa

SEQ ID NO: 2515 - DNA, 60 bp, Eucalyptus sp.
agaggaagatcgttgacccggcaaacggtgctgaatttctgcctacttatgaggacaaag

SEQ ID NO: 2516 - DNA, 60 bp, Eucalyptus sp.
atgttccttgggggatgttcctcactgccgtcaagagactaagaatcatgaggacttctg

SEQ ID NO: 2517 - DNA, 60 bp, Eucalyptus sp.
ccagttttcgaggtccccaattagtaccgctatctaactcacaggtatatcccactactg

SEQ ID NO: 2518 - DNA, 60 bp, Eucalyptus sp.
cgaggaagagaggttatgcggagactgaggtggacttgaagctcaacctcaatctctctt

SEQ ID NO: 2519 - DNA, 60 bp, Eucalyptus sp.
agggatctagttcagattggtacttaacattgaactgcatataacgatcgatggagtatc

SEQ ID NO: 2520 - DNA, 60 bp, Eucalyptus sp.
ttcattttgagtaactttgatgtctacgccgttggtacatgattacataggcttaaaaga

SEQ ID NO: 2521 - DNA, 60 bp, Eucalyptus sp.
tcattcccatccatcccagcttgccaaagtctccagctttcttgagcaggacctcgtttt

SEQ ID NO: 2522 - DNA, 60 bp, Eucalyptus sp.
ataaaagtaatctgaatctaaaggctactgagttgacgcttggtctccctggatctcaat

SEQ ID NO: 2523 - DNA, 60 bp, Eucalyptus sp.
gtgtactgacttctttttgttggacgagtaccatgtgtacaatcagaactatcatgactt

SEQ ID NO: 2524 - DNA, 60 bp, Eucalyptus sp.
gatagtctgacttctatagtacatggaacgtcctttggtaagagctgcgtcataagtact

SEQ ID NO: 2525 - DNA, 60 bp, Eucalyptus sp.
tcattccctcccaatctctctcgtccttctctctcccctgcgtaaaacctttgcgctaat

SEQ ID NO: 2526 - DNA, 60 bp, Eucalyptus sp.
acttatgataatttcacttgtaaatttcgccaaattttataaggtagctatcttccaagt

SEQ ID NO: 2527 - DNA, 60 bp, Eucalyptus sp.
gaattgagtgagccgaacaacgggaaggcctctataataaatgagactatccggctttta

SEQ ID NO: 2528 - DNA, 60 bp, Eucalyptus sp.
ataaaatgtgggtcacgtctgtatttgtagctcactaatcgaaagtatagttagagtctt

SEQ ID NO: 2529 - DNA, 60 bp, Eucalyptus sp.
gaaaagtttggaaaattatggcagttgggtggacgaggcgatatccgggtactacgactc

SEQ ID NO: 2530 - DNA, 60 bp, Eucalyptus sp.
gtagatagtcggtcacaacatactcatatacatcctaataaatgtctgtgtacgtagtta

SEQ ID NO: 2531 - DNA, 60 bp, Eucalyptus sp.
agtccattgccataataacatgctccggtattatgatctacgacagactttaatggtatt

SEQ ID NO: 2532 - DNA, 60 bp, Eucalyptus sp.
ccatttccttagtactctggagatccaaacagaagaccacgaatgtagtgggtggaatga

SEQ ID NO: 2533 - DNA, 60 bp, Eucalyptus sp.
tcgacttaacttaggatcgtgaggagccagattaactattcaggtccacgtcgatatgta

SEQ ID NO: 2534 - DNA, 60 bp, Eucalyptus sp.
tctaccgcactaatatgcaaataagctgcctgtaatgaatatcttttaacgatatcgacg

SEQ ID NO: 2535 - DNA, 60 bp, Eucalyptus sp.
agattcttcaagacttagtccctggatgcaacaaggttattggaaaagcactcatccttg

SEQ ID NO: 2536 - DNA, 60 bp, Eucalyptus sp.
gagtatgtccggtatttacaggaaaaggtacataagtatgaagactcctaccagggttgg

SEQ ID NO: 2537 - DNA, 60 bp, Eucalyptus sp.
ggtgtcatttaacgccttctaatccaaacggcgttagacacaaacaagactcactactat

SEQ ID NO: 2538 - DNA, 60 bp, Eucalyptus sp.
gagcactttcacttatcagaggccgaaagcaaaaccccctgaacacttcaaagaaaagag

SEQ ID NO: 2539 - DNA, 60 bp, Eucalyptus sp.
gagttaagtccttattctccgttaaaccaacactaacgctaacttatgtagcttgtatct

SEQ ID NO: 2540 - DNA, 60 bp, Eucalyptus sp.
agatattcgtccaaattcacgaagagtcgatttgattagattttattgttacctctgatt

SEQ ID NO: 2541 - DNA, 60 bp, Eucalyptus sp.
tgatgcgtactgaataaatgcatgtaacataaattaaaactatgactttgtgaatcagtt

SEQ ID NO: 2542 - DNA, 60 bp, Eucalyptus sp.
ggagattctcatcctatgaagccggaatctgttgaagtactgaatttcggagatagtggg

SEQ ID NO: 2543 - DNA, 60 bp, Eucalyptus sp.
ctccatactagcaactgcatgtcagtttacatgacacggtgatattagcgtagtcctttg

SEQ ID NO: 2544 - DNA, 60 bp, Eucalyptus sp.
ggttcaataaactctagtgattgtatatccgaagctattgtgaaccaagacaagtatatt

SEQ ID NO: 2545 - DNA, 60 bp, Eucalyptus sp.
caagaactgaccatttcggacgatttctgtgtaggcatgtacaacataagtaccttctga

SEQ ID NO: 2546 - DNA, 60 bp, Eucalyptus sp.
gctagcatgtctaggatttaggtgacatctaattctcatgttaaggtgtctgtagctgcc

SEQ ID NO: 2547 - DNA, 60 bp, Eucalyptus sp.
ggcttgggaaagttaatgtttcgactcggtctatcgttgaaatgtgacacagtgcaaaat

SEQ ID NO: 2548 - DNA, 60 bp, Eucalyptus sp.
cgatgtctctgatgttcttacttcatcttgttggcagcggtaaaatgtcagtttcgtgtc

SEQ ID NO: 2549 - DNA, 60 bp, Eucalyptus sp.
agaaaagaaggatttgatccctgttctattatcgtaatattttcctaaatctgctcgttc

SEQ ID NO: 2550 - DNA, 60 bp, Eucalyptus sp.
ttgcataactactagctgggtcctgtcgtaagccttacaataaatctactattagctgag

SEQ ID NO: 2551 - DNA, 60 bp, Eucalyptus sp.
gatgttattacagctctaatctagagtctagatattaaagtgcagcttgaattaacctca

SEQ ID NO: 2552 - DNA, 60 bp, Eucalyptus sp.
cctgttgggtttttgtaaatggagtgacttgagattgctatatcgatggttactgttagt

SEQ ID NO: 2553 - DNA, 60 bp, Eucalyptus sp.
ttgataataatgaaacacagtatgcagcggaaataacattgaccttgtcaaactatttta

SEQ ID NO: 2554 - DNA, 60 bp, Eucalyptus sp.
gtctcgcgccaggaagcaggcgtatacacaagagttggagattaaggttttgcgtctaga

SEQ ID NO: 2555 - DNA, 60 bp, Eucalyptus sp.
ccaaggattagatattagtaacaaaggctctcaaatagtaaaatccgaagccccctccat

SEQ ID NO: 2556 - DNA, 60 bp, Eucalyptus sp.
tggtgaaccgggtttactgtactcgataagtttgacagaacacagttgtgtatagatgag

SEQ ID NO: 2557 - DNA, 60 bp, Eucalyptus sp.
ggatcattgtgaatatagcgataagctgcgcatgcgataaatagctaggcacggtagttc

SEQ ID NO: 2558 - DNA, 60 bp, Eucalyptus sp.
tgatgccaccatatgggccaccttatgctgcaatatactcacatggaggtgtttatggac

SEQ ID NO: 2559 - DNA, 60 bp, Eucalyptus sp.; identical to SEQ ID NO: 2558

SEQ ID NO: 2560 - DNA, 60 bp, Eucalyptus sp.
catgaagccaggagagcctattggttatcccaagatgccgttacaggcttcaatttctac

SEQ ID NO: 2561 - DNA, 60 bp, Eucalyptus sp.
catagtaggtttgctttgtgaattagttacttgttgggtacctgtagtgattcagtataa

SEQ ID NO: 2562 - DNA, 60 bp, Eucalyptus sp.
tctctagtaagcctgctggttcatcgttagattttattggaactagacctactcagctac

SEQ ID NO: 2563 - DNA, 60 bp, Eucalyptus sp.
gaagggatgaacgtttgtaaataagttgtgaaccatacttagttcgatgtctagagagat

SEQ ID NO: 2564 - DNA, 60 bp, Eucalyptus sp.
acagaattacgtatatgatgcatctgaaaccgaaataacactatattcttgggtagtatg

SEQ ID NO: 2565 - DNA, 60 bp, Eucalyptus sp.
gatgttaggttagtggttttttgtgtataggaaaatatgtatggttaggtactgtacata

SEQ ID NO: 2566 - DNA, 60 bp, Eucalyptus sp.
gataatctgcgtcagcaaacactactacaaatgcaccgtttactgacaactcggcagtca

SEQ ID NO: 2567 - DNA, 60 bp, Eucalyptus sp.
gttgtaacattatagcgatgtcatgtttagttcttgcgtaactcctaatgtattctgttt

SEQ ID NO: 2568 - DNA, 60 bp, Eucalyptus sp.
cttcaatcttcgttcgggactctacagcctaagcaggcattctccatgaaccacctcgat

SEQ ID NO: 2569 - DNA, 60 bp, Eucalyptus sp.
agagagttgctctttcgaagggtcagaggtaaaccatcatcaatactatgatttggatta

SEQ ID NO: 2570 - DNA, 60 bp, Eucalyptus sp.
actgcgaatgtgggagtgtcgccttactgagaaactctacgttgggtgtctgtttaaatt

SEQ ID NO: 2571 - DNA, 60 bp, Eucalyptus sp.
tttttcgttatgacgatagctttttagggtttaatcagtattgctaggtgtgaaaattaa

SEQ ID NO: 2572 - DNA, 60 bp, Eucalyptus sp.
tatggttgtttgaatttcagggattccttggggtgattaataataaccccccaatggaaa

SEQ ID NO: 2573 - DNA, 60 bp, Eucalyptus sp.
gccttcttaaacttatttcagtagtctcattatgtcttatcgctgacagtttaaagcttc

SEQ ID NO: 2574 - DNA, 60 bp, Eucalyptus sp.
tggacaccgctcagtggccacaggagattgtggtgaaaccaatagaagatatagtcacaa

SEQ ID NO: 2575 - DNA, 60 bp, Eucalyptus sp.
aatgattacgacaccccaaacccatttactaccttgcactctctaacttatgatcagtcc

SEQ ID NO: 2576 - DNA, 60 bp, Eucalyptus sp.
ctttgggattgtgtgctttaatgagctagactttagcgtcagctctctaaagctacggca

SEQ ID NO: 2577 - DNA, 60 bp, Eucalyptus sp.
aaaagagtaagtctttcaagggttttcataatttaaaagctaaaaaagatagcctcagaa

SEQ ID NO: 2578 - DNA, 60 bp, Eucalyptus sp.
gatataaatgctgggtgattctgttaattcacttgtaacggtttaatgtctatattatgc

SEQ ID NO: 2579 - DNA, 60 bp, Eucalyptus sp.
ctgtgaatgtatagaagatatggagatttccgtgacaccataacgtcctgaatcattata

SEQ ID NO: 2580 - DNA, 60 bp, Eucalyptus sp.
atgtaatagcatggacaccaaattctgttactacaacaactataatgtgaaccagccccg

SEQ ID NO: 2581 - DNA, 60 bp, Eucalyptus sp.
ttttctttgataacccctttttagtattctttcatcggggattttctggggagaagttag

SEQ ID NO: 2582 - DNA, 60 bp, Eucalyptus sp.
gagcaagtagcaaacacatttagtcgactgattgtttagcatccacttttaggtactcat

SEQ ID NO: 2583 - DNA, 60 bp, Eucalyptus sp.
ctgcactgacatatgtgtatgtatatctacatatatgcgtaggcatctgcttctatgtaa

SEQ ID NO: 2584 - DNA, 60 bp, Eucalyptus sp.
gcgttgaaaggccactcttttattgttcaacttcaagcccgcaaccctctctctccaaac

SEQ ID NO: 2585 - DNA, 60 bp, Eucalyptus sp.
tgatgacaggccgatgtctggtcgcgtggctcttattacagtatgttgtatatcgcttga

SEQ ID NO: 2586 - DNA, 60 bp, Eucalyptus sp.
tgcttgcttttctcgttgctttatcatcgggagttggaacagttggtagagatttataat

SEQ ID NO: 2587 - DNA, 60 bp, Eucalyptus sp.
tcccatggtaaatgtttatggtagtatatacttatgtacatggaaatagctgttagtttt

SEQ ID NO: 2588 - DNA, 60 bp, Eucalyptus sp.
ttttgcacctaggtctaaggttacggtgtttgtcttcgtcataatatattgtgcaaaata

SEQ ID NO: 2589 - DNA, 60 bp, Eucalyptus sp.
tgatgagttgacgacctttgtctaacgaggaaataactaataattatgtgggacaaggct

SEQ ID NO: 2590 - DNA, 60 bp, Eucalyptus sp.
ctgatgcagcacaactttgcctctcttgtgatgcaaaagtacattcagccaatgcactgt

SEQ ID NO: 2591 - DNA, 60 bp, Eucalyptus sp.
cctaaaattaaagtgtgtgtctgtgacatgattcttataacttgtaacaaatttaggcag

SEQ ID NO: 2592 - DNA, 60 bp, Eucalyptus sp.
tcgtcctcgtgtcgtctgatgtcgtctagtgtgaaagatctgaattcaaagccgtaggat

SEQ ID NO: 2593 - DNA, 60 bp, Eucalyptus sp.
gcaccagtcgagcttgctgaacatcagcgattacaagtcgatgatgtctcagggcatgaa

SEQ ID NO: 2594 - DNA, 60 bp, Eucalyptus sp.
tcttgtgtgctaattaggttgaatgcacgcgcttgtacataactcttgtaaattattcgg

SEQ ID NO: 2595 - DNA, 60 bp, Eucalyptus sp.
tcttgacctaaactgtgtataaataagcgagatggttcttcgcagtcttatctagagttt

SEQ ID NO: 2596 - DNA, 60 bp, Eucalyptus sp.
accacaagaaacatgttgtacgcattgtggtacaagctcgaaatgtactccaatgatgcg

SEQ ID NO: 2597 - DNA, 60 bp, Eucalyptus sp.
tgaagttccttatgctcaaagtactatggatgtggttgacatgtcaaagcggtctaatct

SEQ ID NO: 2598 - DNA, 60 bp, Eucalyptus sp.
acttctaaagtacctgcctcctgttgataacagccaacttcctgacagccttgagtactt

SEQ ID NO: 2599 - DNA, 60 bp, Eucalyptus sp.
tttatttcgctaaataacaagctactagattgagcgatttagagctatctaatgttgtca

SEQ ID NO: 2600 - DNA, 60 bp, Eucalyptus sp.
cccatggattctattaaagaatagtaaagatgaactctaattcgtgtctacgagagagct

SEQ ID NO: 2601 - DNA, 60 bp, Eucalyptus sp.
ccttctgtaggcccgagagaacgtagattgagtacagagcagttcttagtcggtgcctta

SEQ ID NO: 2602 - DNA, 60 bp, Eucalyptus sp.
ctgttactcttactcaactaaaacttcagcaccacattgtcgttggccttaaagttacag

SEQ ID NO: 2603 - DNA, 60 bp, Eucalyptus sp.
ctttgcctgtgcttttaggattagcgcttgttaattgatttagctagggcttttgtggat

SEQ ID NO: 2604 - DNA, 60 bp, Eucalyptus sp.
agatagtgagacgcgtgagtaataacgttaacaacaacggcaacaatggagggtttatgg

SEQ ID NO: 2605 - DNA, 60 bp, Eucalyptus sp.
tgtagggcttagagaacgtagattgtgtacagagcagtttttagtcggtgcccaacagtt

SEQ ID NO: 2606 - DNA, 60 bp, Eucalyptus sp.
tgaatcagagactgtatttcgcaacgatattcatttgtttcatgaacgcatatcgtattt

SEQ ID NO: 2607 - DNA, 60 bp, Eucalyptus sp.
aaggatttattcgttcattaggcttttgtatttagctagggttgatccgattgttctgta

SEQ ID NO: 2608 - DNA, 60 bp, Eucalyptus sp.
atcctccatcagagccagttaagcttgacttaaacctccggctctgatcaacttgttcat

SEQ ID NO: 2609 - DNA, 60 bp, Eucalyptus sp.
agcgaagcccatagttcggcagtcgtgggcagttacaattgccgtaatactagtagcaag

SEQ ID NO: 2610 - DNA, 60 bp, Eucalyptus sp.
tctctctcaaacatggctgaattagattattgccaaaccaaaagcagacccggcgctgcc

SEQ ID NO: 2611 - DNA, 60 bp, Eucalyptus sp.
atcgtttcttaagccttcgagtaatctttgacaggtaatttctgtggccatgcgtcagtg

SEQ ID NO: 2612 - DNA, 60 bp, Eucalyptus sp.
tttcttttgtcctttcgtccgctgggttcttatggcttgcttgaagagggttaagtaatt

SEQ ID NO: 2613 - DNA, 60 bp, Eucalyptus sp.
caatcggattacaaggcacatctcaagacttgtggaactagagggcactcgtgtgactgt

SEQ ID NO: 2614 - DNA, 60 bp, Eucalyptus sp.
acaattgcaaatcagattaaaatacccgctcgagcaatgatctggacctaatcaagtact

SEQ ID NO: 2615 - DNA, 60 bp, Eucalyptus sp.
gaccgagtcgagcctctaagacccatctacccatcttcggttcagttcgatatagtcgaa

SEQ ID NO: 2616 - DNA, 60 bp, Eucalyptus sp.
tctagcagcagcaccagttctagcagcaatagcaaaacaagcactagtgtaatagcaggc

SEQ ID NO: 2617 - DNA, 60 bp, Eucalyptus sp.
tcttcgaacgattcagtttgtaatgttggctacaattgaatgtgtacttgcttagttaga

SEQ ID NO: 2618 - DNA, 60 bp, Eucalyptus sp.
gaccggacgttgagtgggtatcggatctggtgaattgattcggatcttggtaagtgggaa

SEQ ID NO: 2619 - DNA, 60 bp, Eucalyptus sp.
tatgtacctggaggctttaaggctgtgtctcagatgcttaatctcggtggcaaccctact

SEQ ID NO: 2620 - DNA, 60 bp, Eucalyptus sp.
tgctaatgatttcagactgaagttactgtacatatatggtgtaactgacggacggcatga

SEQ ID NO: 2621 - DNA, 60 bp, Eucalyptus sp.
ggttgcactggtaatttcccttatcactaatatagattgtgcaatattgtcgctaggaca

SEQ ID NO: 2622 - DNA, 60 bp, Eucalyptus sp.
aatgaagtttcagtaagcattcttaaaatattcgcaatgcaattgcagatttctgtatag

SEQ ID NO: 2623 - DNA, 60 bp, Eucalyptus sp.
ttcttattacattagaacaggcctttgtagatttggtgctacatgtcgatttaatcatcc

SEQ ID NO: 2624 - DNA, 60 bp, Eucalyptus sp.
catcacataatactaagggacttcctataagaccgggtgaagtggactgtcctttctacc

SEQ ID NO: 2625 - DNA, 60 bp, Eucalyptus sp.
tctctacctgacataaacaatgggttctacagtaccgatgagttccggatgtatgctttc

SEQ ID NO: 2626 - DNA, 60 bp, Eucalyptus sp.
tgtgatactaccgcttattgatgatgatgataataataataattcggacatttagtacca

SEQ ID NO: 2627 - DNA, 60 bp, Eucalyptus sp.
caccaacaaaaccgggttttaagagggttggtatgaaaaggtgaaggcacacagccacca

SEQ ID NO: 2628 - DNA, 60 bp, Eucalyptus sp.
gtgagaacacagataactatattttgtgagaacacagataactatattgagtgtagcaac

SEQ ID NO: 2629 - DNA, 60 bp, Eucalyptus sp.
atctctctgcaacacactttccattcaccacgcaggagaagaacatcgtatcagatccaa

SEQ ID NO: 2630 - DNA, 60 bp, Eucalyptus sp.
aagctgtgaattccagtgttgatctgccaacacaatttgttaagacatcaactgctcaag

SEQ ID NO: 2631 - DNA, 60 bp, Eucalyptus sp.
ttcttaatgcttgaatcttaggtcatcatagctcagaaagaataacgacaatttgatgaa

SEQ ID NO: 2632 - DNA, 60 bp, Eucalyptus sp.
gatatcattatacgttccgagcttgtattttatgtatggatgtttacctaatgtaattag

SEQ ID NO: 2633 - DNA, 60 bp, Eucalyptus sp.
ttctggcattaagaactagatgttctattcggccattgtgatcgagtatgtcgctagttt

SEQ ID NO: 2634 - DNA, 60 bp, Eucalyptus sp.; identical to SEQ ID NO: 2633

SEQ ID NO: 2635 - DNA, 60 bp, Eucalyptus sp.
actgtccaggagtgcgtctccgagtttatcagcttcataaccagcgaggcaagtgacaaa

SEQ ID NO: 2636 - DNA, 60 bp, Eucalyptus sp.
ggaatagttggcttagtggtcttgtttgtggtagttgtatgctttagaggccctattgtt

SEQ ID NO: 2637 - DNA, 60 bp, Eucalyptus sp.
gccgaatggtgtcgcgataagcaatctggataatcacactggtacttatttgagtgtaaa

SEQ ID NO: 2638 - DNA, 60 bp, Eucalyptus sp.
aatatatctcaccatagctgtatagtctgtaaagataaatgggcctcgaaattagtcatg

SEQ ID NO: 2639 - DNA, 60 bp, Eucalyptus sp.
aaccaaaaccaattcgcggctagtttcaaagaggaatcaaccatccgatgagccgaaggc

SEQ ID NO: 2640 - DNA, 60 bp, Eucalyptus sp.
tctttagcatttatagcttctctgatctgatctgatctagcggtttattctgcccacccc

SEQ ID NO: 2641 - DNA, 60 bp, Eucalyptus sp.
aactataacgatggatgtagctcagttgaagcggcagttatttgagtacaccactctact

SEQ ID NO: 2642 - DNA, 60 bp, Eucalyptus sp.
cagattttggtgttcaaaagaagagcacaagatcttcctaatgcagaacataacattaga

SEQ ID NO: 2643 - DNA, 60 bp, Eucalyptus sp.
atggaggtaaaaagttcaaacttgtaaaatttatgcgcgtttgtatttccttatttgttt

SEQ ID NO: 2644 - DNA, 60 bp, Eucalyptus sp.
atgtagtctatgtagatactcttgtcttctctttcaattataggtcatacagactttatt

SEQ ID NO: 2645 - DNA, 60 bp, Eucalyptus sp.
tgagaggctccttaagacctcctcatatcaagttactacagttgattccggtagcaaagc

SEQ ID NO: 2646 - DNA, 60 bp, Eucalyptus sp.
atgatcggcatattcatggctaggaatggcgcaccttttgttcagtaaatataatatgat

SEQ ID NO: 2647 - DNA, 60 bp, Eucalyptus sp.
tttaacgggttgaaggtggatttgataataacagactattgtatgcctggaatgactggt

SEQ ID NO: 2648 - DNA, 60 bp, Eucalyptus sp.
gaaagtgaactatttaacttggtaagtattatataggtagcttagacgtcattgtatatg

SEQ ID NO: 2649 - DNA, 60 bp, Eucalyptus sp.
tgtagggctgaatattctgtattcaattcatctggctaattggcctagctcctagcccgc

SEQ ID NO: 2650 - DNA, 60 bp, Eucalyptus sp.
tgatgctggtagattggcacgataaggccatctaaatgttagagtctggctggggtaggt

SEQ ID NO: 2651 - DNA, 60 bp, Eucalyptus sp.
aaggtgtcttaataactgttttggcaatgaatgacttatgcttacattatctagactatt

SEQ ID NO: 2652 - DNA, 60 bp, Eucalyptus sp.
tgacacattatttttggactagagtttcttccgggtcttcaaaccttgctcttctatgta

SEQ ID NO: 2653 - DNA, 60 bp, Eucalyptus sp.
ttggaatgctatgataagacagattgctgaatacaaccaattatagtgtgctacatgtcg

SEQ ID NO: 2654 - DNA, 60 bp, Eucalyptus sp.
aggcatcatattcctacgtagatatgaaacctaattggtttagtttgtctcccactaaga

SEQ ID NO: 2655 - DNA, 60 bp, Eucalyptus sp.
ataatttgcgtcgcccaaatgtgtacactatttataagtagataagcaatgggggctttc

SEQ ID NO: 2656 - DNA, 60 bp, Eucalyptus sp.
tctcaagaagttattgaccgaataattcaggtttgtagagtttgtaactgttgacgactt

SEQ ID NO: 2657 - DNA, 60 bp, Eucalyptus sp.
gaaaactgtctgttcatgaaactgatcaagagatgtccgctgcgagtgataagtatcctg

SEQ ID NO: 2658 - DNA, 60 bp, Eucalyptus sp.
ggatgtgaactctagtattattaaagggcctggagggggtatgccgagctacgatatact

SEQ ID NO: 2659 - DNA, 60 bp, Eucalyptus sp.
attgtcgcctaagctaatggtgattactgagcaagagtcaaaccataatggcaccttaat

SEQ ID NO: 2660 - DNA, 60 bp, Eucalyptus sp.
ctttgattagtcttgtcatatttgtgataatattttattctgtggaaagataaactggtt

SEQ ID NO: 2661 - DNA, 60 bp, Eucalyptus sp.
tacaaagtcccattcgagttccatgctgcattgataccaggttcggatttactgcttcac

SEQ ID NO: 2662 - DNA, 60 bp, Eucalyptus sp.
tatgtagatctttgtggctgtaacatgtacttcttgcttacctgttcgatgctatataat

SEQ ID NO: 2663 - DNA, 60 bp, Eucalyptus sp.
gggatccactataagtcgtgtgatcgcttactatactgaggctttagcgctgcgagtcac

SEQ ID NO: 2664 - DNA, 60 bp, Eucalyptus sp.
tattgtgtagagctatcattaagtaaattcgatttgtgattttatccaggtggtactttc

SEQ ID NO: 2665 - DNA, 60 bp, Eucalyptus sp.
atcctaacaagccgaagaggcctgccagtgcattcttcatcttcatggaagatttcaggg

SEQ ID NO: 2666 - DNA, 60 bp, Eucalyptus sp.
ttgttgttacccaagtaacataatctatcttatgtctccgccgtttatggtctagcattt

SEQ ID NO: 2667 - DNA, 60 bp, Eucalyptus sp.
aggatgtgccagtggcgctcattagcatgcacagttgcggccttgatgccaaaattaaga

SEQ ID NO: 2668 - DNA, 60 bp, Eucalyptus sp.
aatatgcagatgtaccaccatctgtgggctggccaaactcctcactgaagaagttaactg

SEQ ID NO: 2669 - DNA, 60 bp, Eucalyptus sp.
cattgtgatgcagtttgaaaccgactatgtggttcaaagcacattgtctatgaatgatga

SEQ ID NO: 2670 - DNA, 60 bp, Eucalyptus sp.
ttctagcgaatgattgctcttaggatatgtgtagatactgacccgtgcgctgtaaaattc

SEQ ID NO: 2671 - DNA, 60 bp, Eucalyptus sp.
cagaagcatctcgtttcaggcaaagcatgaaggttcatcagttcgcacgtggattctttg

SEQ ID NO: 2672 - DNA, 60 bp, Eucalyptus sp.
atggggttcccaagtatgaagacagtcagcctgtatttccggataaactaacgcgtttga

SEQ ID NO: 2673 - DNA, 60 bp, Eucalyptus sp.
ctgctcttctggaagagagcttcaaacagcatagcactctcaaccctgacgaagctcaag

SEQ ID NO: 2674 - DNA, 60 bp, Eucalyptus sp.
gcttcaaacagcatagcactctcaaccctaagcaaaagcaagctctagcgaggcagttga

SEQ ID NO: 2675 - DNA, 60 bp, Eucalyptus sp.; identical to SEQ ID NO: 2673

SEQ ID NO: 2676 - DNA, 60 bp, Eucalyptus sp.
cgcggcctccctgtgtagacatagtgtaaactcgtttgtacgtatatctacgtgttaagt

SEQ ID NO: 2677 - DNA, 60 bp, Eucalyptus sp.; identical to SEQ ID NO: 2676

SEQ ID NO: 2678 - DNA, 60 bp, Eucalyptus sp.
acttcccatgaagattacagcattaagataaagcctagtcaataattcccgggttcttct

SEQ ID NO: 2679 - DNA, 60 bp, Eucalyptus sp.
caagaaaaaggactaaatcttcaatctttcagcctcaaaggaagcgaaatcccctaggaa

SEQ ID NO: 2680 - DNA, 60 bp, Eucalyptus sp.
cttggagccaagctgtgggaagtacattaatatgttattctccacgagataacttataag

SEQ ID NO: 2681 - DNA, 60 bp, Eucalyptus sp.
ctttgtgccgctaactgaaacacgaaacttatcaatcggtattgactctgatataacctt

SEQ ID NO: 2682 - DNA, 60 bp, Eucalyptus sp.
ctctctctagacaataagtgggcattcaaagctctgtgctttccaccgaaaggactccag

SEQ ID NO: 2683 - DNA, 60 bp, Eucalyptus sp.
gtatcatatatgaggggatacgctataagtatgcaataagctccatcaatagctagcatc

SEQ ID NO: 2684 - DNA, 60 bp, Eucalyptus sp.; identical to SEQ ID NO: 2683

SEQ ID NO: 2685 - DNA, 60 bp, Eucalyptus sp.
ggataaacgccatggcagcttaagggtagagtctccgctacgatgcatttagctataagt

SEQ ID NO: 2686 - DNA, 60 bp, Eucalyptus sp.
aaatcctccctcacttctaggtgcatagtttgatccctctcattctcatggatgaaatgt

SEQ ID NO: 2687 - DNA, 60 bp, Eucalyptus sp.
gaggtcgatggtgaaccgcagtacacacctagtctgtactatagcagcaacaagaccaat

SEQ ID NO: 2688 - DNA, 60 bp, Eucalyptus sp.
gagcgaaaattcgagtagtatgcagttccttattgcacgcggcattccggttataggatg

SEQ ID NO: 2689 - DNA, 60 bp, Eucalyptus sp.; identical to SEQ ID NO: 2688

SEQ ID NO: 2690 - DNA, 60 bp, Eucalyptus sp.
ctcgtaataattctaatcctaacatggtgtggtatgcgagacaaaaccagaccagaccct

SEQ ID NO: 2691 - DNA, 60 bp, Eucalyptus sp.
tttctaacgtctgtcatacgacattatgtaaattatgagtgcacaatcagacttggtaag

SEQ ID NO: 2692 - DNA, 60 bp, Eucalyptus sp.
gggttgtgggtgtatagtacaatagctctcgcttagttccatacacgtatagtagataga

SEQ ID NO: 2693 - DNA, 60 bp, Eucalyptus sp.
aagtaatctttactgcgcaaacaattttatgtcactgggtatctgtttgttacgctaatg

SEQ ID NO: 2694 - DNA, 60 bp, Eucalyptus sp.
ttgtcccagtaaccgagagtgcggatccttagattgtggaattaatatggcgacttacta

SEQ ID NO: 2695 - DNA, 60 bp, Eucalyptus sp.
cactttggatcaggagcgttgagaccggccgtgagatacttaactatgacgagtacgtga

SEQ ID NO: 2696 - DNA, 60 bp, Eucalyptus sp.
ctttttaggcgatagtgaaatcacgaacacgatttagtattatggtgttagaagcaacac

SEQ ID NO: 2697 - DNA, 60 bp, Eucalyptus sp.
tttttaggcaatagtgaaatcacgacacgcgatttagtattatggtgttagaagcaacac

SEQ ID NO: 2698 - DNA, 60 bp, Eucalyptus sp.
attgaacactacatcaaatcctgctaatcccctttcatttgtgggaggaattctatgtgc

SEQ ID NO: 2699 - DNA, 60 bp, Eucalyptus sp.
caccgcggtagcttgcctagtgatgtaatatttaatattgaatggttatgatcatagatt

SEQ ID NO: 2700 - DNA, 60 bp, Eucalyptus sp.
gaggtggtttttagttgccttatcacgaatatatctttcatcttatcccttgtattaatt

SEQ ID NO: 2701 - DNA, 60 bp, Eucalyptus sp.
tttggttgacttgatgtaagccgttacgcacctgatttaactagaaatttagctgtaact

SEQ ID NO: 2702 - DNA, 60 bp, Eucalyptus sp.
atagttgtgtcgttaccaatcacgtcaagccggtcgtccgtagtaacagcaacgtaacac

SEQ ID NO: 2703 - DNA, 60 bp, Eucalyptus sp.
gaagagtggtgagaggctgtgtcaaacagattagataacagggtctacttagttcatcat

SEQ ID NO: 2704 - DNA, 60 bp, Eucalyptus sp.
gcaactggaatacttggcttccaaggcttgatctcaagcttcaggcaacataagagcatt

SEQ ID NO: 2705 - DNA, 60 bp, Eucalyptus sp.
ttgggtttcgtattgaccatctttgtccattgtacaacatgctcataatatgattgtatc

SEQ ID NO: 2706 - DNA, 60 bp, Eucalyptus sp.
ttttatttctttctgcgcttgtgttgttaccagttatgtataaataaaagcgtttatagt

SEQ ID NO: 2707 - DNA, 60 bp, Eucalyptus sp.
ctatcgaggaattctaccaaaaggagtgaagttacccaacaataaatacgatagaaagag

SEQ ID NO: 2708 - DNA, 60 bp, Eucalyptus sp.
ttattaaaatacccgactacacacttgcatagtataaacatatgttaagtttatttatat

SEQ ID NO: 2709 - DNA, 60 bp, Eucalyptus sp.
ccgatcgcgatacttgtaatttaaattaccttagttagggatatctattcgcactagctt

SEQ ID NO: 2710 - DNA, 60 bp, Eucalyptus sp.
actatggttgtgaattcgaagtgaaacttctcgacgaaaaatagcatgatttagttctag

SEQ ID NO: 2711 - DNA, 60 bp, Eucalyptus sp.
agaataccgtatacccaactgagaaggtgagtgtgaatggaactccgtaccacaaaagct

SEQ ID NO: 2712 - DNA, 60 bp, Eucalyptus sp.
tttctgcaacttggttagctgatcatctattttcggttttgtggggggtgaatgattgaa

SEQ ID NO: 2713 - DNA, 60 bp, Eucalyptus sp.
aattgagagtgaacatgttcattaaaattttaattcacgatgagtgtatactttgttgtt

SEQ ID NO: 2714 - DNA, 60 bp, Eucalyptus sp.
aacaccgccattactaacactgcgccaatgaccactaactatacttacccactaactata

SEQ ID NO: 2715 - DNA, 60 bp, Eucalyptus sp.
tcttgctcagttgctctagacaatatcgatacaataatgtaccgttgaatccaggagaaa

SEQ ID NO: 2716 - DNA, 60 bp, Eucalyptus sp.; identical to SEQ ID NO: 2715

SEQ ID NO: 2717 - DNA, 60 bp, Eucalyptus sp.
acctgacacaagtctaataatacctgttcaataggatataatacgaatcactgcaatatc

SEQ ID NO: 2718 - DNA, 60 bp, Eucalyptus sp.
cagcaaattttcgcgtatcttaggagcatggcgagaggcaaaattcagatgaagcgaata

SEQ ID NO: 2719 - DNA, 60 bp, Eucalyptus sp.
gaagcgctatcctagtgcaagcaataaattagagcaatatcaatatgaccatgtatcgat

SEQ ID NO: 2720 - DNA, 60 bp, Eucalyptus sp.; identical to SEQ ID NO: 2719

SEQ ID NO: 2721 - DNA, 60 bp, Pinus radiata
tgtacacgtatgtttcgattgttagcttgttgtaaccatgtaaatttgcacacttatgtc

SEQ ID NO: 2722 - DNA, 60 bp, Eucalyptus sp.
aaggtttgagcatacactggctataatagctgtcatttgtccaaagctggtacgagcttg

SEQ ID NO: 2723 - DNA, 60 bp, Eucalyptus sp.; identical to SEQ ID NO: 2722

SEQ ID NO: 2724 - DNA, 60 bp, Eucalyptus sp.
actttcaatgtgtagtcgttaatggttatctcaacggatgtataatagtgcctgtaacta

SEQ ID NO: 2725 - DNA, 60 bp, Eucalyptus sp.
cttctgcctgcgataagtagactttattagcacgtgtgaaaacaatactatgagctcatt

SEQ ID NO: 2726 - DNA, 60 bp, Eucalyptus sp.
tttgggtccctatgtactaaactgaatatgaactatcgaactctagccgtgttaaactaa

SEQ ID NO: 2727 - skipped

SEQ ID NO: 2728 - DNA, 60 bp, Eucalyptus sp.
accatctgttaatgatataagccgatgagatcatattaactgtcacaaataaagacgaat

SEQ ID NO: 2729 - DNA, 60 bp, Eucalyptus sp.
gaaggacagtatgaatccaatctagcttactattttgtataagaataaacatctgtgctg

SEQ ID NO: 2730 - DNA, 60 bp, Eucalyptus sp.; identical to SEQ ID NO: 2729

SEQ ID NO: 2731 - DNA, 60 bp, Eucalyptus sp.
ttcttatcgtatatatccagtcgattatgtaaccataatgtaacatgtcttagtacatgc

SEQ ID NO: 2732 - DNA, 60 bp, Eucalyptus sp.
cttctatgaatatgatcgcatgcttgatttcttgtcctaaacatactttttaagcatggt

SEQ ID NO: 2733 - DNA, 60 bp, Pinus radiata
taaatattaaaatgtctgtatatatagctatgaatttacagttgtattgtacttccattt

SEQ ID NO: 2734 - DNA, 60 bp, Eucalyptus sp.
actcgtctaattaaagctcagttaatatgtagcactagcaactggacgtattggcactct

SEQ ID NO: 2735 - DNA, 60 bp, Eucalyptus sp.; identical to SEQ ID NO: 2734

SEQ ID NO: 2736 - DNA, 60 bp, Eucalyptus sp.
agagatagagagtttattagtgggtgagggtgttaaaaaatgggaagagggagggttcag

SEQ ID NO: 2737 - DNA, 60 bp, Eucalyptus sp.
tattctgatatattgtcctggactcctggttgaataggacggaattctatcgttctgtgc

SEQ ID NO: 2738 - DNA, 60 bp, Eucalyptus sp.
cgtcgattcggactggcctcgttatgtatacaattttgtgttaatttgatccgtgactct

SEQ ID NO: 2739 - DNA, 60 bp, Eucalyptus sp.
aagtagacgacatagtcttgatgttctctacttgtaacgtctttgtgatttaagtaattt

SEQ ID NO: 2740 - DNA, 60 bp, Eucalyptus sp.
gaaattttagtgtagcgtattgtaacgtagagtctgaagtgcttgtgaatatgaatgtca

SEQ ID NO: 2741 - DNA, 60 bp, Eucalyptus sp.
gattgaaatgtatcatgagctaatacctgaatttatatggcccttaaagtttctatctct

SEQ ID NO: 2742 - DNA, 60 bp, Eucalyptus sp.
agcatttagatcctaccaccccataatggtatagtacttttcaggcagggaatgatagtt

SEQ ID NO: 2743 - DNA, 60 bp, Eucalyptus sp.
accagtttggtcactcaaactggcgtgcacttcctagacaagcaggtctgttaagatgtg

SEQ ID NO: 2744 - DNA, 60 bp, Eucalyptus sp.
agataaacttcagcctactgagttttatgattttctccaagtaaataccgactctaacaa

SEQ ID NO: 2745 - DNA, 60 bp, Eucalyptus sp.
gatacataactcatcaaataaaccgatgacttgactttgtatgtgtagatatatagcttg

SEQ ID NO: 2746 - DNA, 60 bp, Eucalyptus sp.
ctgtttttccaaactgttataaagatctgagcataactttgtgacctgtcgaaaaaatag

SEQ ID NO: 2747 - DNA, 60 bp, Eucalyptus sp.
gtggaatcccaagtctttattttggagacgaatttcgaagagtattacgaccagtggcaa

SEQ ID NO: 2748 - DNA, 60 bp, Eucalyptus sp.
aaggttaatctatatagcctcgtgaagaaaacttaggttaggggaaagatagggtcgtcg

SEQ ID NO: 2749 - DNA, 60 bp, Eucalyptus sp.
caaatacatacccgtctgaatcctacaggctgttttcgactaactgtagtccgtcaatca

SEQ ID NO: 2750 - DNA, 60 bp, Eucalyptus sp.
aaggaaaggagttccgtggacggaagaagagcatcggacattcttaatggggctagagaa

SEQ ID NO: 2751 - DNA, 60 bp, Eucalyptus sp.
tgtgatgatgtgtgttatttgatgtaaacaaaccttccactcggtattgtacttatttga

SEQ ID NO: 2752 - DNA, 60 bp, Eucalyptus sp.
tttcagggcgtcaaagtgtactgtcgttcgtttgtttagacccacactgtggtactagaa

SEQ ID NO: 2753 - DNA, 60 bp, Eucalyptus sp.
aaactaaagtacttgatgtcaattggcaaattggttaaggtgaaacgcaagtataggatt

SEQ ID NO: 2754 - DNA, 60 bp, Eucalyptus sp.
caggaacttcgtgatcacgagaacaccgacgcaagtagctagccacgcacagaaatactt

SEQ ID NO: 2755 - DNA, 60 bp, Eucalyptus sp.
gctctaggagttgactacgtaaacatcctgacctactgtgcgaataatgtatgattagca

SEQ ID NO: 2756 - DNA, 60 bp, Eucalyptus sp.
agcttttaacaaaattaaagttagcaagtatatttaacatgggtcaccactcatgctgca

SEQ ID NO: 2757 - DNA, 60 bp, Eucalyptus sp.
gaaggtcttaagttctaggtcatagtgaggggagaatgtccgaaaaaagcatttagttcc

SEQ ID NO: 2758 - DNA, 60 bp, Eucalyptus sp.
tcatgatcgatttcaacgtggacgacattagccagttcctcgactcggatttctacaagc

SEQ ID NO: 2759 - DNA, 60 bp, Pinus radiata
attttacaataacgcacaggacgaagactggatccatgagcttgactgcttagagaactc

SEQ ID NO: 2760 - DNA, 60 bp, Eucalyptus sp.
acatagctgcaggtattatgcccagttttcatgcacaatatgacgtcttagctacatgca

SEQ ID NO: 2761 - DNA, 60 bp, Eucalyptus sp.
ttgatgttaatgtattctagtcttagactatggctaattatggctaattacggtccccct

SEQ ID NO: 2762 - DNA, 60 bp, Eucalyptus sp.
gttgacgaaacaaggtattgaccccgttacccacaagccacttagagaattaaacagcat

SEQ ID NO: 2763 - DNA, 60 bp, Eucalyptus sp.
tcaatattatgcttctatggtaggcccagttagataggcatagatagatagtaaatcata

SEQ ID NO: 2764 - DNA, 60 bp, Eucalyptus sp.
ttccagtgcttactcgattagccaataccagagggtcgttccaagtccattcgggtatgt

SEQ ID NO: 2765 - DNA, 60 bp, Eucalyptus sp.
gtaaaggagactggcgagggatagctcgtgactttgtgactacaaggactcctactcaag

SEQ ID NO: 2766 - DNA, 60 bp, Eucalyptus sp.
agacacatgacacaacagtttaagagggtattgatatttataaggtttagtcagtaccat

SEQ ID NO: 2767 - DNA, 60 bp, Eucalyptus sp.
gtccggtcatggacacctactcctccggagaagacttaattgttaagacgaggaagcctt

SEQ ID NO: 2768 - DNA, 60 bp, Eucalyptus sp.
cctccgttgcgggaagagttgtaggctaagatggataaactatttgcggcctgacctcaa

SEQ ID NO: 2769 - DNA, 60 bp, Eucalyptus sp.
agtacaaaggaatacgcatgatgcgtgactgcagttagtacgcacggacgattaatcgcg

SEQ ID NO: 2770 - DNA, 60 bp, Eucalyptus sp.
ctgctatggagttaagttcgtctaaaaatgtaggtttgtgaattatagcatgtatcccag

SEQ ID NO: 2771 - DNA, 60 bp, Eucalyptus sp.
ttcttggtaacaagtggtctttaattgccgggagattgcctgggaggacggacaacgaga

SEQ ID NO: 2772 - DNA, 60 bp, Eucalyptus sp.
tgttctgttgttttttgtattgaggttttacgtgcggactcgagagtcatgattttgaag

SEQ ID NO: 2773 - DNA, 60 bp, Eucalyptus sp.
aaaacgtcgaaccttagctttcactaataactgcagcgttaggaagcggcagaactgaga

SEQ ID NO: 2774 - DNA, 60 bp, Eucalyptus sp.
caagcgctcttatttggttgaatacctgttagatcatatatgttgctgcttactagtaaa

SEQ ID NO: 2775 - DNA, 60 bp, Eucalyptus sp.
actgtaaatatgttttgggctgtaaatcttgggaatatttgggtaattttgcatctacgg

SEQ ID NO: 2776 - DNA, 60 bp, Eucalyptus sp.
aagccctggctacatctgaatactctggctctagtgagttcgacagttcgacagtcactg

SEQ ID NO: 2777 - DNA, 60 bp, Eucalyptus sp.
taaaggaaatggaccctatcaattttgaaactgttctattgttgatgaggaacctcacct

SEQ ID NO: 2778 - DNA, 60 bp, Eucalyptus sp.
ccagagcaacgacggctcctttggatactacgcacagttaggttcatagtctttcgggaa

SEQ ID NO: 2779 - DNA, 60 bp, Eucalyptus sp.
ttctggtttagtttagaaagttctgaaatatttgcagttaggaaaacccggctaagcctt

SEQ ID NO: 2780 - DNA, 60 bp, Eucalyptus sp.
gaagtttagagactaatgcagggctggaggatagtctagttatttatgcgtagaccaatc

SEQ ID NO: 2781 - DNA, 60 bp, Eucalyptus sp.
tctatttaatgctctatctccatcaggtatctgttaagtttgtcggcttacatgtgactg

SEQ ID NO: 2782 - DNA, 60 bp, Eucalyptus sp.
agcccgagacattccgagacatcgaaaatgtctaccgacgataatagtgcctctgagtcg

SEQ ID NO: 2783 - DNA, 60 bp, Eucalyptus sp.
atggatgtgggtagacaataaaggtagagagaaacgtcaagttggtaggtttgcaaattt

SEQ ID NO: 2784 - DNA, 60 bp, Eucalyptus sp.; identical to SEQ ID NO: 2761

SEQ ID NO: 2785 - DNA, 60 bp, Eucalyptus sp.
ttttaagtagagtaaaaaagaaataattttggccgatgtacagtgggaaaagaaccaggg

SEQ ID NO: 2786 - DNA, 60 bp, Eucalyptus sp.
ctgttgcgtagtcgtagttttgggccaggggttctattcggtatatgtagagaagtcagt

SEQ ID NO: 2787 - DNA, 60 bp, Eucalyptus sp.
tgcagatcatgacaggcagtgagagttaccgtgagtcgtagtcctttatatacacgtctc

SEQ ID NO: 2788 - DNA, 60 bp, Eucalyptus sp.
gtgcacatgtaactgttgaggtaaatcttgtagtatctctaaaactgagtcctgacattc

SEQ ID NO: 2789 - DNA, 60 bp, Eucalyptus sp.
ggcttggctgctttcgtaggggcaaatccattaggacattaaacttaggtctccattatt

SEQ ID NO: 2790 - DNA, 60 bp, Eucalyptus sp.
tcaatcatagcacagccgagagccctaaagtgactttaagctgtcatattagtgaagtga

SEQ ID NO: 2791 - DNA, 60 bp, Eucalyptus sp.
attaccgtgatcagcattacagtacgattacagaaacgagattgttctagtgtctgctta

SEQ ID NO: 2792 - DNA, 60 bp, Eucalyptus sp.
aaaagagcaaggtacgaagccttagcgaaagagaataacactacattcatcaccccaaac

SEQ ID NO: 2793 - DNA, 60 bp, Eucalyptus sp.
gctttggaagaaccgcataagagtttcgagggtcatgtgttacattgccagaaagctgtc

SEQ ID NO: 2794 - DNA, 60 bp, Eucalyptus sp.
catcatatatgatttgctgtaacagaaagtcttttatcagttccacttcgacaactgaaa

SEQ ID NO: 2795 - DNA, 60 bp, Eucalyptus sp.
ctctagtttgatacatatatgcctggctatctatagacgagatcgacaacgccgagattg

SEQ ID NO: 2796 - DNA, 60 bp, Eucalyptus sp.
gtcagcaagttaatttagtggttgtacattgctgtgatgtaattatatggccttcttatt

SEQ ID NO: 2797 - DNA, 60 bp, Eucalyptus sp.
gaaaaattagggtcagtaaaatgtgggagtatcttgtaaaataataaggaatcggtgaga

SEQ ID NO: 2798 - DNA, 60 bp, Eucalyptus sp.
ttttcaccgaatcattagtcctttctcgcacagcgaaattacacattgccagcccaaaag

SEQ ID NO: 2799 - DNA, 60 bp, Eucalyptus sp.
tggatgttgttaagagtcatgatcgaccgatactgcatgtattaatctagggaatttcag

SEQ ID NO: 2800 - DNA, 60 bp, Eucalyptus sp.
tctctatggctaagacatattgcagacgctaggtggttttagcatcagcactttgtttta

SEQ ID NO: 2801 - DNA, 60 bp, Eucalyptus sp.
caatacgtataaataaacaatcgcagattcatgttgtcatgatttaggtagatgcttagt

SEQ ID NO: 2802 - DNA, 60 bp, Eucalyptus sp.
agagattgaactccatggcagtttgtgtgtaatttaatttgatcgtgttatgtggtgtgg

SEQ ID NO: 2803 - DNA, 60 bp, Eucalyptus sp.
ttgcttaggtctgtaacaagttagtgtcggatataggttctgtttgatagtgcttcgggt

SEQ ID NO: 2804 - DNA, 60 bp, Eucalyptus sp.
ggtacgcattgacaagatggactgattgctcatgtggggctaatagactagagttagtcc

SEQ ID NO: 2805 - DNA, 60 bp, Eucalyptus sp.
aatagctacttcttagacgaaccctttgcagctcaagtgcagtatcagccagttcaggtc

SEQ ID NO: 2806 - DNA, 60 bp, Eucalyptus sp.
ggtggtcggtacagttagcgtttagaatcgtgttaactcatgtcatctcatgtagatacc

SEQ ID NO: 2807 - DNA, 60 bp, Eucalyptus sp.
aaaatatccagggaaattgtttcctgtaagattgtaacaacattgtttcgaaatttcatt

SEQ ID NO: 2808 - DNA, 60 bp, Eucalyptus sp.
tctatgtggtcatacatatatacatctgatgatttttagggctgcttttacattttatat

SEQ ID NO: 2809 - DNA, 60 bp, Eucalyptus sp.
tattactaggaaattaggacagatatggacctccaatcttagtttggcatggatgtaaac

SEQ ID NO: 2810 - DNA, 60 bp, Eucalyptus sp.
tcatgtacctgcagaagccgttttgaatttttctcgtttcgacaaccacgagcgtaccga

SEQ ID NO: 2811 - DNA, 60 bp, Eucalyptus sp.
caaaggaccgtgtgaaactattgggacttcaaagagcgttatgatgagcggcaccatgat

SEQ ID NO: 2812 - DNA, 60 bp, Eucalyptus sp.
cggccgatgctcgtaaaatacatccgctaatcgatgaattcataccaacattagagggag

SEQ ID NO: 2813 - DNA, 60 bp, Eucalyptus sp.
tctccttacttcccgcactctattaatccgatactaaggtagccgtgctttacaaataat

SEQ ID NO: 2814 - DNA, 60 bp, Eucalyptus sp.
aatgtaatttatttagcatattgtcaaagttcaccattagtgaaaatatattgtacgtca

SEQ ID NO: 2815 - DNA, 60 bp, Eucalyptus sp.
gtttcgctagtttcagagatcaataacaataaccacaacagtaacaataacgagcactta

SEQ ID NO: 2816 - DNA, 60 bp, Eucalyptus sp.
gtatgatggcatagataatccggacttcttcttgggattcggctatggaggcagcgacaa

SEQ ID NO: 2817 - DNA, 60 bp, Eucalyptus sp.
tcgcgacagcctgcccactgttccaaataatctagaggcagagctaatgtctcaagattc

SEQ ID NO: 2818 - DNA, 60 bp, Eucalyptus sp.
tgtcgaacaaaaagatcgatctggatgtgattcgcgatgtcgatcttaataagcttgagc

SEQ ID NO: 2819 - DNA, 60 bp, Eucalyptus sp.
tggtaaacatatagatattaaggctaaaaatgacgacaaaaagatcggttccaagataac

SEQ ID NO: 2820 - DNA, 60 bp, Eucalyptus sp.
accttaaagtaattcgacatagaggatggtacgcgtgcacttggcataatcaattaacct

SEQ ID NO: 2821 - DNA, 60 bp, Eucalyptus sp.
acagcatcttatagagatgattattttagaacagtgatccctcttgagtatatctagttc

SEQ ID NO: 2822 - DNA, 60 bp, Eucalyptus sp.
gagtgttcatgtataccaaaaaagtacgtatagaaaactagtttcattacccgcgtagag

SEQ ID NO: 2823 - DNA, 60 bp, Eucalyptus sp.
atcgcctgctaattcgtacctttgtaaccatgggtttttaacaaacttgacatgtaagta

SEQ ID NO: 2824 - DNA, 60 bp, Eucalyptus sp.
gtctatattgttatatgtcgtgtatttaggctgatctgaacaatggatactctaatcata

SEQ ID NO: 2825 - DNA, 60 bp, Eucalyptus sp.
tattctacctgatatgcagcagcattctgagcggtactgtgtagggtctacatccaacgc

SEQ ID NO: 2826 - DNA, 60 bp, Eucalyptus sp.
ctccctatatgggtcgatgttgtttgtaagtactaatggttaattagagtggacctgtct

SEQ ID NO: 2827 - DNA, 60 bp, Eucalyptus sp.
gatcctccgttcaacttatcccagccggtcctaggggtcaaagataatgtatggtatgat

SEQ ID NO: 2828 - DNA, 60 bp, Eucalyptus sp.
ttggagtattgtattggttggattgatacaatatactaaggttttagagtgatacatagt

SEQ ID NO: 2829 - DNA, 60 bp, Eucalyptus sp.
agagcattataaattcggtccaaggtgctgagggtaccatacgtattcgctcattttatg

SEQ ID NO: 2830 - DNA, 60 bp, Eucalyptus sp.
tgaacataatggaggtgccctattgcggtggtgggaagagaatgagggatgtggacttgt

SEQ ID NO: 2831 - DNA, 60 bp, Eucalyptus sp.
ctgttagatcaaataatttaagcttgagattcttggtgggtgaggcgttttgtctcttat

SEQ ID NO: 2832 - DNA, 60 bp, Eucalyptus sp.
gatctgagcgaggtgaagacctattatttgaggcacaaggtttgtgggacgcattccaag

SEQ ID NO: 2833 - DNA, 60 bp, Eucalyptus sp.
aaatctacttccagaataataacagtagtaataatgccgccgcacccaagcacggctccg

SEQ ID NO: 2834 - DNA, 60 bp, Eucalyptus sp.
aagaagatgcacaatgttaggagttgaatcgttaaatgtattaattgaaaaggaaatttg

SEQ ID NO: 2835 - DNA, 60 bp, Eucalyptus sp.
cttgtttcaatcgtctagagggcctttctttaaatcaattccccagttataccataatat

SEQ ID NO: 2836 - DNA, 60 bp, Eucalyptus sp.
tttggtgggctagtttgattgatgtgttgtacacacgtgaggtttttggttgtcgttaat

SEQ ID NO: 2837 - DNA, 60 bp, Eucalyptus sp.
ctaatccgcgattcggtttttcactattcacagtctccctcgaaagcttacacttcacgc

SEQ ID NO: 2838 - DNA, 60 bp, Eucalyptus sp.
tgttttagaatggtttagtgttcgtctaccaaagatctctaatatttagtgttcaggctt

SEQ ID NO: 2839 - DNA, 60 bp, Eucalyptus sp.
tgcatgtaactacagtgtaggcaccgtctcttatgaattgaatgtcctccgcactagagg

SEQ ID NO: 2840 - DNA, 60 bp, Eucalyptus sp.
catttactagatcgctgaatatctcaccgcttggacctagctaccgttaggaccttgcgc

SEQ ID NO: 2841 - DNA, 60 bp, Eucalyptus sp.
gaatatgtaatctctatggatgcagataatatatcgagatcaagtagtacatatattgga

SEQ ID NO: 2842 - DNA, 60 bp, Eucalyptus sp.
atcgaaatagtagtaacatacatattgtatattgaaaagagggttaactgaccacgcacc

SEQ ID NO: 2843 - DNA, 60 bp, Eucalyptus sp.
gtgcaatgtgacttgtcttccgttgtttgtgaatgcactcgccttaggagattaagttga

SEQ ID NO: 2844 - DNA, 60 bp, Eucalyptus sp.
ggtctgagcgcggttccctgtgtcggcaatgtagtatagcttaggttttggtcatccaat

SEQ ID NO: 2845 - DNA, 60 bp, Eucalyptus sp.
agttcaacttgcgcacggaattcaacgcaaacttccacgaggaagacttggtggataggc

SEQ ID NO: 2846 - DNA, 60 bp, Eucalyptus sp.
gagaaggaagttggtccataagacagttgtgagggtgaagattgaagcgaacgtggtgaa

SEQ ID NO: 2847 - DNA, 60 bp, Eucalyptus sp.
ttctttttatctaattttttcccattcctggttaatttattgcttatggataaaataaaa

SEQ ID NO: 2848 - DNA, 60 bp, Eucalyptus sp.
aagatcttctagtcctaggagtactcctgatttgattcgcttgggttgtgacactctatc

SEQ ID NO: 2849 - DNA, 60 bp, Eucalyptus sp.
caggaaaccgatgtcaaaagttcgcaaccgaaagtagattcaccagaactgaggcagttt

SEQ ID NO: 2850 - DNA, 60 bp, Eucalyptus sp.
gagacttcggactgtgttgagactagtcttttgtacgcctaatgggacactaagtaatga

SEQ ID NO: 2851 - DNA, 60 bp, Eucalyptus sp.
gttcatgacatgtattgttacgttgctcatgcagaggtatttaggcactaatcctgtatt

SEQ ID NO: 2852 - DNA, 60 bp, Eucalyptus sp.
gcacgagtactttgtcgagaagatactctcgtgctaccagaagtcgctggcaatgctgaa

SEQ ID NO: 2853 - DNA, 60 bp, Eucalyptus sp.
caaaagaaggaaaaaccgagtgaagaaggtgacgagagtgccggcgatcagcaacaagat

SEQ ID NO: 2854 - DNA, 60 bp, Eucalyptus sp.
aagctactacagatgcacctaccgtaacacccagaattgttgggctacaaagcaagtgca

SEQ ID NO: 2855 - DNA, 60 bp, Eucalyptus sp.
gatgggactgtagatttggtggggagtgaatcatccgactagtggggtggattttcgttt

SEQ ID NO: 2856 - DNA, 60 bp, Eucalyptus sp.
agcgctcgcgtagtggccggattaccgataacatctacttaggcgagcataatcatgcta

SEQ ID NO: 2857 - DNA, 60 bp, Eucalyptus sp.
gcaaccggcaattccaatgataaggctttaaagtcagatgaaaagcctaccgtaatatac

SEQ ID NO: 2858 - DNA, 60 bp, Eucalyptus sp.
atctcctcctgtaactaagcatcagtaactctgtcgtatcaattgctaaggctgaatctc

SEQ ID NO: 2859 - DNA, 60 bp, Eucalyptus sp.
gcatgttaagggctgtgaatttccacgcagctattacaaatgtacctatcctaattgtga

SEQ ID NO: 2860 - DNA, 60 bp, Eucalyptus sp.
tcaagggaagcgagtatccaagaagttattacaagtgcactcatcccagctgtcaagtaa

SEQ ID NO: 2861 - DNA, 60 bp, Pinus radiata
tggccaggcttacaactttttataaactgtgacgtttgtaagacatttgtcgactctttt

SEQ ID NO: 2862 - DNA, 60 bp, Pinus radiata
ccatgttgagggtttcattgtacagtttaatatgttaatctatggtatgggcctctaatt

SEQ ID NO: 2863 - DNA, 60 bp, Pinus radiata
ggctatcactggtagctgtacacagtgattcctggctacttgcagtttctgtgtactttg

SEQ ID NO: 2864 - DNA, 60 bp, Pinus radiata
gtttgaagtcattagtcttttcaaagttatggtcattgtttgaatttgatcacttgaaac

SEQ ID NO: 2865 - DNA, 60 bp, Pinus radiata
cattgtaaaacacgacagtttgaatccatcaagggtttaatgttgaatgggataacctgt

SEQ ID NO: 2866 - DNA, 60 bp, Pinus radiata; identical to SEQ ID NO: 2478

SEQ ID NO: 2867 - DNA, 60 bp, Pinus radiata
ctgtattagtctgagactgatgtttccacatggccgcttcacgtgcgacgacatttattg

SEQ ID NO: 2868 - DNA, 60 bp, Pinus radiata
actgaggggaactttaattgaacttaacagtgatgactatctctgatacctagcggtttc

SEQ ID NO: 2869 - DNA, 60 bp, Pinus radiata
ctacttctgtatccgcagttataagaggagcagaggccgtaaatgtgaaggtaaagacac

SEQ ID NO: 2870 - DNA, 60 bp, Pinus radiata
ttgggttcagcgtacataagactcggcggttttctaaacagaaatccgcattttccttac

SEQ ID NO: 2871 - DNA, 60 bp, Pinus radiata
ttctctgttgtgccagataccgttatttgaaaaacgattgctgaattgatgcccccttag

SEQ ID NO: 2872 - DNA, 60 bp, Pinus radiata
tgagattctattccagttgacggaaaattggggactatgagggtttccaaattaattctt

SEQ ID NO: 2873 - DNA, 60 bp, Pinus radiata
ttgagctagactccggaataccccagcaacaatccgacatggctaaatcctcgcaaaacc

SEQ ID NO: 2874 - DNA, 60 bp, Pinus radiata
tttcatcacagctgactcgacatgcttatcagaattttcagatgtatatctctatgccca

SEQ ID NO: 2875 - DNA, 60 bp, Pinus radiata
aagatagattaacgtatatgctctgtctgcaatttatgagattagtgaggcttccgaggg

SEQ ID NO: 2876 - DNA, 60 bp, Pinus radiata
ccatcatctctttcattcctcacttcaaatcccctttactatcacactacttcctccctt

SEQ ID NO: 2877 - DNA, 60 bp, Pinus radiata
atagcagtagtctaaatagaaaggagagaggattgtaacagtctttacagttacctgttt

SEQ ID NO: 2878 - DNA, 60 bp, Pinus radiata
aagttggcccctagctattttgtaaaatttcggcgtgccaaatcacacctttaaaactat

SEQ ID NO: 2879 - DNA, 60 bp, Pinus radiata
ttttgctcgatagttccgtgcatatagatcatctttgactatagtttcgccgtgtcgatt

SEQ ID NO: 2880 - DNA, 60 bp, Pinus radiata
aagttttataatctcaatcgtgatcttccacacctatattatagtaacctagcccgattt

SEQ ID NO: 2881 - DNA, 60 bp, Pinus radiata
ttgagggaacttcgccgttgttcttcacccccactgccattgagagtggcgattatatta

SEQ ID NO: 2882 - DNA, 60 bp, Pinus radiata
tctggcaatgtacagaaattcgaaaatttaatttcagaattctcttcgacttccggctta

SEQ ID NO: 2883 - DNA, 60 bp, Pinus radiata
gagttggctagctttgggttaggtatcggaattgttgggtagggaggggctccataactt

SEQ ID NO: 2884 - DNA, 60 bp, Pinus radiata
gcagcaatgccgaggatcgtatgtaaagcgtagtctaactaccaaaggtttttgtccttt

SEQ ID NO: 2885 - DNA, 60 bp, Pinus radiata
gtcagtttagcgtattgcctccgaccatttcttttatttcatgtacaggtttacacccta

SEQ ID NO: 2886 - DNA, 60 bp, Pinus radiata
ggaggtcacacaagggatgagtacgaacattttgaatgtattggagttcattcgccacca

SEQ ID NO: 2887 - DNA, 60 bp, Pinus radiata
tttggttatacaaatgtcggcgagatcgtgtatataccaatgtgggcgagatcgtgtata

SEQ ID NO: 2888 - DNA, 60 bp, Pinus radiata
ttttgacttcagtgcataggtatagcaagcattagttctttgtaatcctggccttgatat

SEQ ID NO: 2889 - DNA, 60 bp, Pinus radiata
ctacgacaaattatagtgagccgcaggcgcttgaaatggcggcaaatgcggcaattgtct

SEQ ID NO: 2890 - DNA, 60 bp, Pinus radiata
tgggatgcaaggaaacaggttaattgtcgaagacataagttgtttttgcattagtgaaaa

SEQ ID NO: 2891 - DNA, 60 bp, Pinus radiata
cacagttatactcctgtaattagttacagactatataattatatagcgacttcgttctaa

SEQ ID NO: 2892 - DNA, 60 bp, Pinus radiata
catttaggaagagtacaaaagtagctacggtaaacacctggtgttgtaaggtccatattc

SEQ ID NO: 2893 - DNA, 60 bp, Pinus radiata
aatacataacaggcaggaagactagtggtttgtgttgcaagcctatgtatagcatgtact

SEQ ID NO: 2894 - DNA, 60 bp, Pinus radiata
tttgttgctcagcgctattatatcttccctgggagatatgcggctgtatgatatttcttg

SEQ ID NO: 2895 - DNA, 60 bp, Pinus radiata
tgtggatacctctataaacgtcaacactgggacagaaagttttggcgtagatacctctat

SEQ ID NO: 2896 - DNA, 60 bp, Pinus radiata
aagtgtaatctgccccccctaagtctgcaatcattatggccgtagaccgaattcgagtca

SEQ ID NO: 2897 - DNA, 60 bp, Pinus radiata
aaaatagtgaggatcctgtaagctgtggaattgccggagaaatgagtctaggaattctga

SEQ ID NO: 2898 - DNA, 60 bp, Pinus radiata
gcctgtactttgtatgtattctttctatatgtaccaaaagtttgtattcttgactactga

SEQ ID NO: 2899 - DNA, 60 bp, Pinus radiata
caagaagtcgagtacgcagaaatgagtgtgttggatcgaattcggaaccatttactcggt

SEQ ID NO: 2900 - DNA, 60 bp, Pinus radiata
ttatgccaggtagtcatgttctttagtatacatcatgtacagatacagagtcaatttaac

SEQ ID NO: 2901 - DNA, 60 bp, Pinus radiata
gtactagtgtaaagttagcattcagtagttgcagtttttagcatgatgggctatgcctaa

SEQ ID NO: 2902 - DNA, 60 bp, Pinus radiata
gtttgacggtgctactgtgatttaatctgcacatttatttttggattaggtttaacttat

SEQ ID NO: 2903 - DNA, 60 bp, Pinus radiata
tttgatgttgcaggcctatgtctagcctgtacagtcttttaaactcatttagtacttttt

SEQ ID NO: 2904 - DNA, 60 bp, Pinus radiata
gtttatcaaagcagtcctgtttcttgcctctaagtcttatcataaatacatagcaagttt

SEQ ID NO: 2905 - DNA, 60 bp, Pinus radiata
agaaagctaagcttaactttaccgatgattcatgctcagtagaaatggacagtagcaaga

SEQ ID NO: 2906 - DNA, 60 bp, Pinus radiata
ttgatcctatactggatcgcttgtaaacataaacatgtactgattatttaactgtaagtg

SEQ ID NO: 2907 - DNA, 60 bp, Pinus radiata
cctttagaggaaattggatatcctctgtcaattttctttcaatgatatattcaaatttct

SEQ ID NO: 2908 - DNA, 60 bp, Pinus radiata
ataaatagttttgatagctgatctccttatggaaattaacggaaattttagtaatttttt

SEQ ID NO: 2909 - DNA, 60 bp, Pinus radiata
ttttcagaagctatgtgtagtaaacaaatatggtggtcaggcaaatacagtttggaggac

SEQ ID NO: 2910 - DNA, 60 bp, Pinus radiata
gcagtagggggaaatcgcgccccagtcacctaactaatctaatgtcgacataactatgga

SEQ ID NO: 2911 - DNA, 60 bp, Pinus radiata
tggtgaaatacatggcgaaatattttgttggaagcaggtctggactctcctcaaacacac

SEQ ID NO: 2912 - DNA, 60 bp, Pinus radiata
actaatgattgaaagctccagtaaagggatcccaaatggaggagatcccattagcagcag

SEQ ID NO: 2913 - DNA, 60 bp, Pinus radiata
ctgtttctgatacattcttagctaggattcacttgttgatttattaatctcaaaccaaaa

SEQ ID NO: 2914 - DNA, 60 bp, Pinus radiata
cgtgggatctagtcgttctaatgcttccagcgtcacggcatcgactctaacagaacatga

SEQ ID NO: 2915 - DNA, 60 bp, Pinus radiata
tgtgaaaactgaattccgtcagtctaaaaaagtgacttggaagcacagacctgttctcta

SEQ ID NO: 2916 - DNA, 60 bp, Pinus radiata
ttgggcatcaaggttttcccagccagtcagcaacaatgttgctgagcttatcatacatct

SEQ ID NO: 2917 - DNA, 60 bp, Pinus radiata
ggctgttacaattgggtatgatgggatcgcttcagtgcaataagtggatgtcctttttgg

SEQ ID NO: 2918 - DNA, 60 bp, Pinus radiata
cataggagtactgtctctaccaagatgtgattgggagttccaacgtctgttctaggactg

SEQ ID NO: 2919 - DNA, 60 bp, Pinus radiata
tggtcatgacatgtcttgaactggagatcgctcgaacacttacagttggtataaacatct

SEQ ID NO: 2920 - DNA, 60 bp, Pinus radiata
cacaattaaaggccgatcaagctccgaattgtactatctccatactcctggttaattcaa

SEQ ID NO: 2921 - DNA, 60 bp, Pinus radiata
taatttttagtatagagtcctgtgtttccagatgtgccgacccgtatcgcaatatagctt

SEQ ID NO: 2922 - DNA, 60 bp, Pinus radiata
tttattctaacttgaacatgactggtgctgaccatactagggtcctgctactgagatacc

SEQ ID NO: 2923 - DNA, 60 bp, Pinus radiata
ttcaaagttaagattggataaaggcaatgctaatgggcttaaatactcccataatgttgt

SEQ ID NO: 2924 - DNA, 60 bp, Pinus radiata
agttgggtttttagcctcattgtacttacgtttatggtaaaagccaattcatctctagat

SEQ ID NO: 2925 - DNA, 60 bp, Pinus radiata
cgtacgacgattcccagttcctagctaacaggctaaggcagcatcaactgagcggtaatt

SEQ ID NO: 2926 - DNA, 60 bp, Pinus radiata
caggaagggaggacagcgaattacatggttcccttagtttcaatcaatatgatcaaagag

SEQ ID NO: 2927 - DNA, 60 bp, Pinus radiata
tgcacatgagttcgctgatcctggggcggctaatactaaacgagtttcagtcaacgaagg

SEQ ID NO: 2928 - DNA, 60 bp, Pinus radiata
atgagatatacctaaagttttaatctaataacatgcaccaaccatctgtactttgtccca

SEQ ID NO: 2929 - DNA, 60 bp, Pinus radiata
attgcctcttttacccggtttaatctgagagagatatattcagcgattctaagaatctct

SEQ ID NO: 2930 - DNA, 60 bp, Pinus radiata
ttactttaccagcccagaaggaattgtgcactgtaaaataatccaacttaatttactttg

SEQ ID NO: 2931 - DNA, 60 bp, Pinus radiata
gagaactaatgggcatggtggacatctttaacgctgtattctgttaagcagagtctattt

SEQ ID NO: 2932 - DNA, 60 bp, Pinus radiata
gatgttgtaacgattcggacattattgtatggtattgcgttttcaattgtcaagatgttc

SEQ ID NO: 2933 - DNA, 60 bp, Pinus radiata
ctattcatgcgtctccaacatatcaattagcacattactcttatctgtcaatctgtatag

SEQ ID NO: 2934 - DNA, 60 bp, Pinus radiata
tgtttaggtcagttaaatacatataccatatatatttcatccgtcgtttgcgcctctact

SEQ ID NO: 2935 - DNA, 60 bp, Pinus radiata
gaattagctagataggaatgtaaagtatttagaagtaattatccagtataatcacacaag

SEQ ID NO: 2936 - DNA, 60 bp, Pinus radiata
tgtgaataccaacatttatcttggagtcgtaatctcttttaccctctttcgggcgtgctg

SEQ ID NO: 2937 - DNA, 60 bp, Pinus radiata
tgtggagacatacagtttaggatagcacatccaaagaaagctatacgttgtcagttttca

SEQ ID NO: 2938 - DNA, 60 bp, Pinus radiata
gacatcaatgaacacatggcgaaagcttaaagggtacatcttgtaatactgtaaacattc

SEQ ID NO: 2939 - DNA, 60 bp, Pinus radiata
cccaacctctgaattgcccctataaatcgatatcccatgctagcataaacgggctataat

SEQ ID NO: 2940 - DNA, 60 bp, Pinus radiata
gcactaatatagtgaccgatgcttgttaatctagaaatttaattagcctggattatgacc

SEQ ID NO: 2941 - DNA, 60 bp, Pinus radiata
gccatccaatgtggagtgtaaaggtcaacgtgccatccgggtacaaactattgtaggaaa

SEQ ID NO: 2942 - DNA, 60 bp, Pinus radiata
ttggacagtccattgatttgttcgtacctattattttatgtctatgctttttggaaagca

SEQ ID NO: 2943 - DNA, 60 bp, Pinus radiata
tgaaggcctaccttagcagtttaatccgtagattatatctgtcgtatagcataaagcgat

SEQ ID NO: 2944 - DNA, 60 bp, Pinus radiata
gttgactcggggttgcgtgtggcagaaggcaggtatctgattcgctgtaactattattgc

SEQ ID NO: 2945 - DNA, 60 bp, Pinus radiata
gtgaaaacaacccttcatgttaatgcctcttttacagccatagttacatgactgttttta

SEQ ID NO: 2946 - DNA, 60 bp, Pinus radiata
gtattttaccgtggacctcattactgtttgatataacacctagatgacatataggctgac

SEQ ID NO: 2947 - DNA, 60 bp, Pinus radiata
atatctgaaacttgaaagtgaaatgttgctgtggacgggcttctgcttgtattcatggtt

SEQ ID NO: 2948 - DNA, 60 bp, Pinus radiata
acttcgtttggtcttacctcgagagtctaaatttttacccacttagataatgattctgtt

SEQ ID NO: 2949 - DNA, 60 bp, Pinus radiata
catctaatcatatgaatgaatgtactgtatctgtatgaacacatgaactgtcctggaaca

SEQ ID NO: 2950 - DNA, 60 bp, Pinus radiata
gacaaaaaattaagatctgtctggctgcatccttctggttagctgcaacactttgtgaaa

SEQ ID NO: 2951 - DNA, 60 bp, Pinus radiata
gaagaacagccatacatactattagtgtttcaagtcgatcgaagtttgtttattcagctt

SEQ ID NO: 2952 - DNA, 60 bp, Pinus radiata
catcactcagggttgtctgttatctttgtattgtaataagtcgtcaatataactttcctg

SEQ ID NO: 2953 - DNA, 60 bp, Pinus radiata
aacatctatgtaaatggattattgtattgtcaaatagcatctagcatggctgggtaaacc

SEQ ID NO: 2954 - DNA, 60 bp, Pinus radiata
tcaacgatgatccataggaatactttcactttctccgttctccattaaatacattgcact

SEQ ID NO: 2955 - DNA, 60 bp, Pinus radiata
tgaagttaaccccaggatttggctaaaccataacacatttctcatctcgttaagtgtata

SEQ ID NO: 2956 - DNA, 60 bp, Pinus radiata
acatgtgaccttgaaaggagttacgtctaattctatgttctgcctgggttgactgattct

SEQ ID NO: 2957 - DNA, 60 bp, Pinus radiata
gatctttttggttaatgattcatatgtataagaggttttgagttggggagcgtttttgtt

SEQ ID NO: 2958 - DNA, 60 bp, Pinus radiata
tttcagagtcggtgcatgacaatctgactataatcagctaaatgcttgaagggatataga

SEQ ID NO: 2959 - DNA, 60 bp, Pinus radiata
tctccctccctttcatgctccggggaaggtgttagcagaacaaaatcatagagagagcct

SEQ ID NO: 2960 - DNA, 60 bp, Pinus radiata
tgttctttgcaggtcatctatttcaaaagggttgctaagttatggaggaataactccata

SEQ ID NO: 2961 - DNA, 60 bp, Pinus radiata
ctagtcactcttgtgttacatagctgctacctagaggaaatgacaacacgaaatacgtct

SEQ ID NO: 2962 - DNA, 60 bp, Pinus radiata
ttcatttaaatgattacctagctcacctgtgtgtacgtagaggctcagtgcgtgagtttt

SEQ ID NO: 2963 - DNA, 60 bp, Pinus radiata
acatcggttattctgtacaactagttttgtaaacagtagaataatttttcagtaagaaag

SEQ ID NO: 2964 - DNA, 60 bp, Pinus radiata
aacatacatgaagtccagttagtttatatatctattaatggcgaggcctgctagccttta

SEQ ID NO: 2965 - DNA, 60 bp, Pinus radiata
aatagttcgatcaatcggtgttgcaagtgatatgctatagtgtctattttgaagttcttg

SEQ ID NO: 2966 - DNA, 60 bp, Pinus radiata
attactacgagtaaactttgcgctagcttgatcaatgtacctgcttcagagagacgtcat

SEQ ID NO: 2967 - DNA, 60 bp, Pinus radiata
gacatctacaggctgtaatttattactcaatagcttcttaagcattggcagtgcagtaga

SEQ ID NO: 2968 - DNA, 60 bp, Pinus radiata
attgtgctagagattgaccgccatctagtggtgtaactgatgactttaattgtcagtcat

SEQ ID NO: 2969 - DNA, 60 bp, Pinus radiata
ctggtcagtatgctaattttacactgtaaatgcttgaataattggaatcccgtcgttcaa

SEQ ID NO: 2970 - DNA, 60 bp, Pinus radiata
gttgctgactatacctttacacacacactcttacctgtgtagtgcaacactgtgggaacg

SEQ ID NO: 2971 - DNA, 60 bp, Pinus radiata
tggttctttcccattcatgtagttcaatggatgtaaacaggttctagatataccagttgc

SEQ ID NO: 2972 - DNA, 60 bp, Pinus radiata
aaacactcttatgtattgagagtggtttgttaataagcacaccgggggatctatccacac

SEQ ID NO: 2973 - DNA, 60 bp, Pinus radiata
aataatatctacgcggctgcagcaaaaccttactatagggtagacgaagaacagaacatc

SEQ ID NO: 2974 - DNA, 60 bp, Pinus radiata
tctgatgatcggctttacttaattagggttacgacaggctgttttaaaatgctagatgaa

SEQ ID NO: 2975 - DNA, 60 bp, Pinus radiata
aatggtaatgaaaagccaggaaggcctgaatatctcaattatgtctatgtctacttgtag

SEQ ID NO: 2976 - DNA, 60 bp, Pinus radiata
gcaaagctatttagcatatggttatttttttacaacttatgtgatgactactttagcatc

SEQ ID NO: 2977 - DNA, 60 bp, Pinus radiata
ttattactctaggtgtactatatctttggtgcaagtaatagccatagctagagtatgcta

SEQ ID NO: 2978 - DNA, 60 bp, Pinus radiata
attgatcatacacagcgtattataatcgttatcattattgtcattatactctgaagccgg

SEQ ID NO: 2979 - DNA, 60 bp, Pinus radiata
gttctggaactaggttggtgataaggcatgcactgtactatgctgttcttagttatgata

SEQ ID NO: 2980 - DNA, 60 bp, Pinus radiata
gataatatttcagtataccatttgacaatttttgaagcatagggctgtgcattgacgaga

SEQ ID NO: 2981 - DNA, 60 bp, Pinus radiata
accctagtcctctaaagactcatgctcctcgtaacctcggtctctctaccgctaattcat

SEQ ID NO: 2982 - DNA, 60 bp, Pinus radiata
tgtcaaagtcaccagtttgcgttggacaaggctggatgaatttcattgtaactagaaatt

SEQ ID NO: 2983 - DNA, 60 bp, Pinus radiata
acatttactttgtgaagtatcccaatctggattagtttgtttctccgttaaatccgcttc

SEQ ID NO: 2984 - DNA, 60 bp, Pinus radiata
taatttctatttcgagacacaacatagtttgcaaggctgaattccttaaagtatccaaaa

SEQ ID NO: 2985 - DNA, 60 bp, Pinus radiata
agagcatgctttagtctcaaccactaggttttggcatttgtaatacaacaagcgctggtc

SEQ ID NO: 2986 - DNA, 60 bp, Pinus radiata
tcctttactgtctacaataaacatagttaatgagctagacagtccagtatcatggcaacc

SEQ ID NO: 2987 - DNA, 60 bp, Pinus radiata
ttttaagggttcgattcgggattttgatatttgtttgtgttcttgcggggtggagacagt

SEQ ID NO: 2988 - DNA, 60 bp, Pinus radiata
atgattagcataaagttatacacaattggatgtaattataccccatacccacccatagag

SEQ ID NO: 2989 - DNA, 60 bp, Pinus radiata
atccgtgacatgctagtctgtgacaaactaaaggtaccttccacatggggtctgacatgt

SEQ ID NO: 2990 - DNA, 60 bp, Pinus radiata
caagttttacaaatcggaaatcgactgtttaaagggttattatatgaccagttattattt

SEQ ID NO: 2991 - DNA, 60 bp, Pinus radiata
aatgttataaaagtgagggactcttcctgtctctagtctatatacttggacaaacattgc

SEQ ID NO: 2992 - DNA, 60 bp, Pinus radiata
attttagtcttggaagcaccactgtattgtcatgcaatcaagattagttttactagcttt

SEQ ID NO: 2993 - DNA, 60 bp, Pinus radiata
tttaacttgttatccattcttttgtgcctttattgtctgggtaaactattttatcggcaa

SEQ ID NO: 2994 - DNA, 60 bp, Pinus radiata
aaatgggtcatggtaatggagactgtaaagtttaaactataaaatgtaaagttgaattcc

SEQ ID NO: 2995 - DNA, 60 bp, Pinus radiata
attctcatgctgtaatcatcctagataaggatgactgataacgtttgcctacatgctatt

SEQ ID NO: 2996 - DNA, 60 bp, Pinus radiata
gttgctctcctgtgaaatgggcacaactcaattattcggttattgtatatactgttttaa

SEQ ID NO: 2997 - DNA, 60 bp, Pinus radiata
ctaacatgggctagcttctaaattcgtcatggtttgagggaatgcctgattgtgcgtgtg

SEQ ID NO: 2998 - DNA, 60 bp, Pinus radiata; identical to SEQ ID NO: 2997

SEQ ID NO: 2999 - DNA, 60 bp, Pinus radiata
catattcaacaggtcagattttgcaggaagtggtcattagagaatctgtataagatgctt

SEQ ID NO: 3000 - DNA, 60 bp, Pinus radiata
agcttttagcttgacctaaatgataggtagttgtgatagctagctttattgtacatggaa

SEQ ID NO: 3001 - skipped

SEQ ID NO: 3002 - DNA, 60 bp, Pinus radiata
ctctgtgttgagtggggacccgacatggtgtttgtatagcacatagttgcaattaatata

SEQ ID NO: 3003 - DNA, 60 bp, Pinus radiata; identical to SEQ ID NO: 2996

SEQ ID NO: 3004 - DNA, 60 bp, Pinus radiata
atcgtgaggttgagtggaggccagaaagtatcaatttagaatgatcaggctgattgctca

SEQ ID NO: 3005 - DNA, 60 bp, Pinus radiata
ctcttgtcttgggaaagatgcatgtacttatttttggattctactattctgttactatgc

SEQ ID NO: 3006 - DNA, 60 bp, Pinus radiata
ttttcaagaattgtattccgggatgataatcttgccaaatgtgtaatcatagtgaagagg

SEQ ID NO: 3007 - DNA, 60 bp, Pinus radiata
tttcttatttgtttcgattcggtgctttgggtagcttaaatagcctcgtgtcaagctttt

SEQ ID NO: 3008 - DNA, 60 bp, Pinus radiata
atcatggataatttcttgtcaagtgtcttttgatgcttcccaattgcaatgtgatagaaa

SEQ ID NO: 3009 - DNA, 60 bp, Pinus radiata
ttgttaaaatttatactccgaggctaggctacttgagggatgagattggacttatatgtt

SEQ ID NO: 3010 - DNA, 60 bp, Pinus radiata
cgtggcttcaacgcattgatcatttatcattaatattacggatctcacggctattggcag

SEQ ID NO: 3011 - DNA, 60 bp, Pinus radiata
tgcacgggcagctagtgtgttattctattccaactttcatagcatctctctatgatgcat

SEQ ID NO: 3012 - DNA, 60 bp, Pinus radiata
atcatgggtttcataaatgcaactttggtaattgagaaatggaaatcatgttttacttct

SEQ ID NO: 3013 - DNA, 60 bp, Pinus radiata
tttggatactcgagtcacatttggagccatctgtcacgcgatatctacttgaactgcaac

SEQ ID NO: 3014 - DNA, 60 bp, Pinus radiata
gagactagcaccttctgctgcaactcctcgaggcgagtatgtcatggtagaagacttatc

SEQ ID NO: 3015 - DNA, 60 bp, Pinus radiata
ttgagatatgtgatcagataatgttttggaagctactttgctacctgtatattttaatac

SEQ ID NO: 3016 - DNA, 60 bp, Pinus radiata
tcattttatgctccaactctatcactggttcaccgtacttacctgaaagttaattgttca

SEQ ID NO: 3017 - DNA, 60 bp, Pinus radiata
tctcaattattacctccgtggtactggtatgtcatgtagagtatcaatctgactggcaga

SEQ ID NO: 3018 - DNA, 60 bp, Pinus radiata
taaactgtcatagctaaaggctaaatgaaatggccttagactttcaggacttagaacact

SEQ ID NO: 3019 - DNA, 60 bp, Pinus radiata
atgtatgagagttccaaagtttatacgaatcaagataaaacacgttccaaagggtataac

SEQ ID NO: 3020 - DNA, 60 bp, Pinus radiata
gagtatgctgtggcaacccaccaaggtccaggactttatagcacagtatcaaacactacc

SEQ ID NO: 3021 - DNA, 60 bp, Pinus radiata
tgcaaggggttgtacgtgcatctcagatatttaatttttccacactcagctagctattca

SEQ ID NO: 3022 - DNA, 60 bp, Pinus radiata
gcagtacatgtccaatttcatcgatagtacttgtatgaatggagagagtatcttatcccc

SEQ ID NO: 3023 - DNA, 60 bp, Pinus radiata
tgcaataagcgcagtagaggtcccccgagtattcattctgttgaatcactcgaactagag

SEQ ID NO: 3024 - DNA, 60 bp, Pinus radiata
tttaactcgggcagaggcagcgagcaaaactttcaatatcagtgttacacgcctcggcta

SEQ ID NO: 3025 - DNA, 60 bp, Pinus radiata
atgtcatgaggtatctaatctctaaaatcacatctaattggggtcacatgactaatgtat

SEQ ID NO: 3026 - DNA, 60 bp, Pinus radiata
atactacatgcctgaggtgcacttttcatatggaacttgtagagtcagataggggcacat

SEQ ID NO: 3027 - DNA, 60 bp, Pinus radiata
aattcatgattgtacatgtttgtggcctgttttttatggttaagtcaacattcacttgcg

SEQ ID NO: 3028 - DNA, 60 bp, Pinus radiata
aattatttaacaatattttactcggaggcagaggtggaacgaatccgggacaactgagga

SEQ ID NO: 3029 - DNA, 60 bp, Pinus radiata
ttgacagtggtgggcacctatgttgtctcggactgtactaagatcgggtttggagatgtg

SEQ ID NO: 3030 - DNA, 60 bp, Pinus radiata
attggttagtttgtacattgatcgttcttttcacgttagctttacgatttaggtcgattc

SEQ ID NO: 3031 - DNA, 60 bp, Pinus radiata
ttccatgttcatgagatttaggtatatcacgactttcactccccatgaacctttgtacac

SEQ ID NO: 3032 - DNA, 60 bp, Pinus radiata
ttttcttttagccttgatgtcttagctggtagattttaagctgacttaaaaacacacaga

SEQ ID NO: 3033 - DNA, 60 bp, Pinus radiata
ttagggttatgtcggcagtgcctatatggtccgtggttctgccatttggcctcgagtaat

SEQ ID NO: 3034 - DNA, 60 bp, Pinus radiata
tgttcagcggctcttaattcgttgttgctgctgaacggaggttagtttgataaactaccc

SEQ ID NO: 3035 - DNA, 60 bp, Pinus radiata
ccgagtactctgccatggtgggagtactggccttgagccttgctcagtagtagtaaatta

SEQ ID NO: 3036 - DNA, 60 bp, Pinus radiata
caagtaacaagcattatctgatattccattatagttaccatccattgtctggcatagctt

SEQ ID NO: 3037 - DNA, 60 bp, Pinus radiata; identical to SEQ ID NO: 3036

SEQ ID NO: 3038 - DNA, 60 bp, Pinus radiata
agaatgtatgttggttttgcatatgttggattaatcatttccagccagtattctttccag

SEQ ID NO: 3039 - DNA, 60 bp, Pinus radiata
ttttgaggccggggaagccaaattttactctttttacaataatcataatattattatgag

SEQ ID NO: 3040 - DNA, 60 bp, Pinus radiata
ttttgaagggtggctgcatagacattctcttcactcatgatgtatagcaatttctaatgg

SEQ ID NO: 3041 - DNA, 60 bp, Pinus radiata
agtagctaattttctatttagttcattttgtacgatctatctcatcacagcaaaatggtt

SEQ ID NO: 3042 - DNA, 60 bp, Pinus radiata
gtttatataggttcatactgaagtaggactctttgcctgaaagtcaaatcggtagaccca

SEQ ID NO: 3043 - DNA, 60 bp, Pinus radiata
caatgctgtagatttgtctgactcatcttttatatgtatagctggatctctaaaatgggc

SEQ ID NO: 3044 - DNA, 60 bp, Pinus radiata
gtgaatgccacattcgtcacttacaaaagtcaggtgaaaggcgcttgaaataaatttaaa

SEQ ID NO: 3045 - DNA, 60 bp, Pinus radiata
tgataatacttacagtagtagatcaactcgttactcaccctacaccatacgttattgcac

SEQ ID NO: 3046 - DNA, 60 bp, Pinus radiata
ttgaagagatcatatggtgtacataattctattcatcatctttttggttgtatcaacaaa

SEQ ID NO: 3047 - DNA, 60 bp, Pinus radiata
taatattcctgcttgcccgctgtaactctctttgttttgatatagcagaaacatattaca

SEQ ID NO: 3048 - DNA, 60 bp, Pinus radiata
tgtatgtatgcttgacctaacccaacactttttaatacgaggctacctactatattagtg

SEQ ID NO: 3049 - DNA, 60 bp, Pinus radiata
cattctcaagggaacgctcgtcaggatgataccgaatgtaaaagtatttaatatgcaagt

SEQ ID NO: 3050 - DNA, 60 bp, Pinus radiata
aatgggtttactgccttttgaagcgtttgtaactttaagttttatgccagctggacagaa

SEQ ID NO: 3051 - DNA, 60 bp, Pinus radiata
ttggttgggcttaatttttgtgtatcaggggttctaagaacaggtattataaggtgaatt

SEQ ID NO: 3052 - DNA, 60 bp, Pinus radiata
attttattaagcttgtttggctaatactctcagaactcatatacctattagacaatttgg

SEQ ID NO: 3053 - DNA, 60 bp, Pinus radiata
caccgcgtttattgcatttgcattgatgtccttaggctgtgtcgtggttaattattagta

SEQ ID NO: 3054 - DNA, 60 bp, Pinus radiata
ttctgaatcacctcatgaaacagattgtggtgaaattaagctatagatgtgaaacaccat

SEQ ID NO: 3055 - DNA, 60 bp, Pinus radiata
aattgtaaccttcccgaacaacggcggtagaggtctggagattcgcatgtacgaagataa

SEQ ID NO: 3056 - DNA, 60 bp, Pinus radiata
gtgtcggctctctcagacgataacgacagactgaggcgcaacaattcgatgctgttatca

SEQ ID NO: 3057 - DNA, 60 bp, Pinus radiata
gtcactgtttatgtgtcctaatgaattgctccaaatagattctctataagctgctgtcag

SEQ ID NO: 3058 - DNA, 60 bp, Pinus radiata
ttgaacccttagaatacgattacgatctgtaccctgtctaaaacagattgcctcgagctt

SEQ ID NO: 3059 - DNA, 60 bp, Pinus radiata
agctacagtaataagttccatctagcatttagaatttcaaacaactatctttggatgagg

SEQ ID NO: 3060 - DNA, 60 bp, Pinus radiata
tcaagtgtagctccgtgattattgggcatttgtgttctcactgtgaccttgcatatcaga

SEQ ID NO: 3061 - DNA, 60 bp, Pinus radiata
tgtaatgtttaatcctatgtttggttatgtatcctgggttctagattgtaacgaaactct

SEQ ID NO: 3062 - DNA, 60 bp, Pinus radiata
aataatgttacggtcttagataacagataacttcgtctacattacatgcagttaatatct

SEQ ID NO: 3063 - DNA, 60 bp, Pinus radiata
caaataagctactacattacccttcctgttattttgtaaaccaattctcaacagtgtgaa

SEQ ID NO: 3064 - DNA, 60 bp, Pinus radiata
cttgcatctagggttatcttcgcagccaaacatttgaaacacttattcgtcgtcttccgt

SEQ ID NO: 3065 - DNA, 60 bp, Pinus radiata
gtatatttaaggacaacgacgaggtatcctatgtctatatatccataagacaataagtca

SEQ ID NO: 3066 - DNA, 60 bp, Pinus radiata
taatgctccggaacaaaggagcttccagtaataatagaatttttaggtgcttcggtgcac

SEQ ID NO: 3067 - DNA, 60 bp, Pinus radiata
atcgaaataggttgtagtccagcctcattgtttggcaaaattcagatagacgctctaatc

SEQ ID NO: 3068 - DNA, 60 bp, Pinus radiata
aagttatgaatatcacattccagatttagctatgtaaatggtcatgacggcgttgtatgt

SEQ ID NO: 3069 - DNA, 60 bp, Pinus radiata; identical to SEQ ID NO: 2721

SEQ ID NO: 3070 - DNA, 60 bp, Pinus radiata
gatgcacttgcccacatatgatggactctgtgtagcttccaactagacaggatgtactgt

SEQ ID NO: 3071 - DNA, 60 bp, Pinus radiata
gaatttgaaaatccacgacaaatggaaaactggttctatgttagaggatcatacatattt

SEQ ID NO: 3072 - DNA, 60 bp, Pinus radiata
ttgtaaatggtttggttggtttgaaaaacacaatctcttaaaagttggcgatggattaaa

SEQ ID NO: 3073 - DNA, 60 bp, Pinus radiata
atgaagcatggatagtgtaaaaaaaagacatgttttttcaggacgaaaaagcataattat

SEQ ID NO: 3074 - DNA, 60 bp, Pinus radiata
ttttatattaataaaaggtaaagctgcttctcatatcgcacctaattgttcaccacgtcc

SEQ ID NO: 3075 - DNA, 60 bp, Pinus radiata; identical to SEQ ID NO: 2733

SEQ ID NO: 3076 - DNA, 60 bp, Pinus radiata
atcaactcaaagtaagttgggctctttggaagtttacactgttgtttatgtacagtacaa

SEQ ID NO: 3077 - DNA, 60 bp, Pinus radiata
attattatacactacggtttatcacatggtagtcgattcgccatacttttcaagtgtgaa

SEQ ID NO: 3078 - DNA, 60 bp, Pinus radiata
caaggactccatcataccctctcatatcataaattattataaacggacgtggtaacaatt

SEQ ID NO: 3079 - DNA, 60 bp, Pinus radiata
ctcattcactcatacgaggttgtaagaatgatactttccatggattactatgttgtgttg

SEQ ID NO: 3080 - DNA, 60 bp, Pinus radiata
tatgaatccttaattaactaattatgaagagggcataagaagcgttgctgtatgtgattt

SEQ ID NO: 3081 - DNA, 60 bp, Pinus radiata
ttgcaggagtgtaataaatgatgtagatatttttctccacgattgagttcaatatagact

SEQ ID NO: 3082 - DNA, 60 bp, Pinus radiata
gaaaagttagatgcgcagtaatgtgatttatgcaggttgaacttattttgatggtagaaa

SEQ ID NO: 3083 - DNA, 60 bp, Pinus radiata
aatgttggaggggtggtgatatgatgagtgacagtatagataataagtgaccaattgtca

SEQ ID NO: 3084 - DNA, 60 bp, Pinus radiata
aggatgactgggaaagtacatagttgggtttcatcacctattgatgttttgtgagaccag

SEQ ID NO: 3085 - DNA, 60 bp, Pinus radiata
gtaagagaaaatggctataacgatgctggttccagtaatcttatatcgtatgaagccttc

SEQ ID NO: 3086 - DNA, 60 bp, Pinus radiata
agagttgtagattacgttggttaaactatcttcgtcccgacattaaacgcggagacattt

SEQ ID NO: 3087 - DNA, 60 bp, Pinus radiata; identical to SEQ ID NO: 3086

SEQ ID NO: 3088 - DNA, 60 bp, Pinus radiata
agtatcatgtaaatctaataaattaacccttccgggtttcctctaatgtcgaattcagct

SEQ ID NO: 3089 - DNA, 60 bp, Pinus radiata
cagacaagaagtgtttctaactgaaagggtggaatttaatcccttataagttaaagcttg

SEQ ID NO: 3090 - DNA, 60 bp, Pinus radiata
gaaatccaagaatctctttgtttctctcagaaagacactgtacattaaccaagtaaatat

SEQ ID NO: 3091 - DNA, 60 bp, Pinus radiata; identical to SEQ ID NO: 3089

SEQ ID NO: 3092 - DNA, 60 bp, Pinus radiata
tcccacaactttcaaccgaggactcgaaactcaggaatcatgtcgtgtctatgcataata

SEQ ID NO: 3093 - DNA, 60 bp, Pinus radiata; identical to SEQ ID NO: 2759

SEQ ID NO: 3094 - DNA, 60 bp, Pinus radiata; identical to SEQ ID NO: 3092

SEQ ID NO: 3095 - DNA, 60 bp, Pinus radiata
ctgcagattacgatggatcaattatttgagacctgatatcaggcgaggtaatttcagtcc

SEQ ID NO: 3096 - DNA, 60 bp, Pinus radiata; identical to SEQ ID NO: 3083

SEQ ID NO: 3097 - DNA, 60 bp, Pinus radiata
ccaaagccctacggggcaataacgaatacatgaaaaccgtttggctcatagcaagtctag

SEQ ID NO: 3098 - DNA, 60 bp, Pinus radiata
aactagtccgtattttttgattggaaggttctccgaaagcggttaggaatcgttctagtt

SEQ ID NO: 3099 - DNA, 60 bp, Pinus radiata
ctcgactccgtaattaaggtgtcatttgctaattggataatatgatcactgcttatttaa

SEQ ID NO: 3100 - DNA, 60 bp, Pinus radiata
tgtcaactgatcttctaaatgctgatcagttggtgtatcattgctcaatatgcacctttt

SEQ ID NO: 3101 - DNA, 60 bp, Pinus radiata
gaagagaacgggtctctgttctttacgtctaagattcttggaacgttccacgagtgtata

SEQ ID NO: 3102 - DNA, 60 bp, Pinus radiata
agggagtgaaccaacaggatcaccgttgcattaatatgtctagttctaggtcaaatgtgc

SEQ ID NO: 3103 - DNA, 60 bp, Pinus radiata
tgccgaaaagtgatgtaatcctttgttaataatagcctagtaggactcaacctagcttaa

SEQ ID NO: 3104 - DNA, 60 bp, Pinus radiata
tgttttcagtgtacctttttcatatcgttcaatgaaactcactagctgggcttagttaaa

SEQ ID NO: 3105 - DNA, 60 bp, Pinus radiata
caaaggtttgctaaattgttcacacattgtaggtttattgcaatcatattaagtcaataa

SEQ ID NO: 3106 - DNA, 60 bp, Pinus radiata
caagtggaagactaactcaactatcaaggggaaattggagtgccctagagttttctattc

SEQ ID NO: 3107 - DNA, 60 bp, Pinus radiata
cgttcggcttaccgatggcccgatcagaaagagcgctagtatggggaatttgatgatgat

SEQ ID NO: 3108 - DNA, 60 bp, Pinus radiata
ttgctagctaggggctacgtagtaattgtcttgtcatcacgaattcaaatagttcggaca

SEQ ID NO: 3109 - DNA, 60 bp, Pinus radiata
ttccattatgtatatatgggtttcttctgcagcacaaaggttgtgtgcctggttgatatt

SEQ ID NO: 3110 - DNA, 60 bp, Pinus radiata
caagagaaagaatccggaatgaagctgttaatactctctttcactctgactctcttttct

SEQ ID NO: 3111 - DNA, 60 bp, Pinus radiata
agattctgtacttgtactttgcccacaggaattatttggtacgaggtcagatgtgtcaga

SEQ ID NO: 3112 - DNA, 60 bp, Pinus radiata
ttttattttgcaggtagaagcgtacactgtaagttcttcctatggtcgacaaaaatttaa

SEQ ID NO: 3113 - DNA, 60 bp, Pinus radiata
gaatttacctatcaattgcgttaaagatactctgttttcggccctgaaccctaccagggg

SEQ ID NO: 3114 - DNA, 60 bp, Pinus radiata
agcatcgtggctcttcccggcagacctagtaagccgactactgtaaatttattcttttag

SEQ ID NO: 3115 - DNA, 60 bp, Pinus radiata
tttctacctcaaaacatgtttaagttgtgagtggtgagtcgctatgtaaaacatatctat

SEQ ID NO: 3116 - DNA, 60 bp, Pinus radiata; identical to SEQ ID NO: 3092

SEQ ID NO: 3117 - DNA, 60 bp, Pinus radiata
tgaaagagtaactggggataaagtttctggaatatttgtcgggttctgtcacaaagagcc

SEQ ID NO: 3118 - DNA, 60 bp, Pinus radiata
aagtgctacacgcgggagtattgagttagctttcaagatataatcgagtgtgaatgtctg

SEQ ID NO: 3119 - DNA, 60 bp, Pinus radiata
tcatgacccattgggggatctcatatttgttcatccaccacttttgtatgtcagttactt

SEQ ID NO: 3120 - DNA, 60 bp, Pinus radiata
acagattgagccaaagtccagagagttaagtacagaagatccgatatttcgttgtagctc

SEQ ID NO: 3121 - DNA, 60 bp, Pinus radiata
aaaatggatttctcccagagggacagaactgtaaagtgctgaaggcgatctcgatttctg

SEQ ID NO: 3122 - DNA, 60 bp, Pinus radiata
gttgtaagtatcatttgtatacatgccttttgcatcagaacgatacagtctgattatggc

SEQ ID NO: 3123 - DNA, 60 bp, Pinus radiata
ttcaatacgcgaagaagtcaatcaagatcagaagaactgaccaggtttttctcggacaga

SEQ ID NO: 3124 - DNA, 60 bp, Pinus radiata; identical to SEQ ID NO: 3089

SEQ ID NO: 3125 - DNA, 60 bp, Pinus radiata
ttttgtaatagaataaaaattaagagcaagtggaccatccctccctttctctttaatgaa

SEQ ID NO: 3126 - DNA, 60 bp, Pinus radiata
ccagttggtgacttacagcctctgtacctagtctaaaaaggcggcctagtccatagcttt

SEQ ID NO: 3127 - DNA, 60 bp, Pinus radiata
tcttcatgggagtaaaagattggaatggagactcctttatgggaaaaatcctttttgtaa

SEQ ID NO: 3128 - DNA, 60 bp, Pinus radiata
tttgggttccaacgaattgtatctactcatgagttatccgattttcaaggtggcgactat

SEQ ID NO: 3129 - DNA, 60 bp, Pinus radiata
gactctcagttagtcatcccatacactgaatgctatgcccaatttctatgattctgatac

SEQ ID NO: 3130 - DNA, 60 bp, Pinus radiata
aacagccctctaccatccaacaattacatgaacaaatggtaactttaactggcttttcat

SEQ ID NO: 3131 - DNA, 60 bp, Pinus radiata
atgacaatgaacagttgtttgttaaaggttttagacagctgaaaataggtgcttctcatt

SEQ ID NO: 3132 - DNA, 60 bp, Pinus radiata
ggtcaatatctatgatatacaaggctaccacattagtagcctaaatatggttggaagtga

SEQ ID NO: 3133 - DNA, 60 bp, Pinus radiata
ttctactgcttctaaaggagtaaagaagagagtaggcgtcaaaaaggccctcgtcttcta

SEQ ID NO: 3134 - DNA, 60 bp, Pinus radiata
ttatttttgaccttcgattccactgagttcggggacttacacagccagggttattggccc

SEQ ID NO: 3135 - DNA, 60 bp, Pinus radiata
tttccctaacaacatgcacttggtcatgaacttacagcaaggctattggccctggttaaa

SEQ ID NO: 3136 - DNA, 60 bp, Pinus radiata
tttataagagtctgcctgtacagcttaatccggctatagttattctcaaaccatattctg

SEQ ID NO: 3137 - DNA, 60 bp, Pinus radiata
ttattcttatgatctgcaaattaatatactcatgtagtttaaacgttaaagctcctaaaa

SEQ ID NO: 3138 - DNA, 60 bp, Pinus radiata
tgtcaggatagcttgccccaattgcgattatgaaattgacaatagccatgtgactcaaga

SEQ ID NO: 3139 - DNA, 60 bp, Pinus radiata
atagctatctattagcaaaattagattatccgacttcaacggtattccgtctacggagat

SEQ ID NO: 3140 - DNA, 60 bp, Pinus radiata; identical to SEQ ID NO: 2412

SEQ ID NO: 3141 - DNA, 60 bp, Pinus radiata
acaaagcttatattgttctttgatgattgctgtatgatactaatacaagtgcaaaaaaaa

SEQ ID NO: 3142 - DNA, 60 bp, Pinus radiata
gaatgacaaaaattatggtgttctttgatgatcgctgtaagatactactctacaagtgga

SEQ ID NO: 3143 - DNA, 60 bp, Pinus radiata
ttttgtgcatagtgtctatgttatgcaatatgtcatctctatacctaggcgtgtctttaa

SEQ ID NO: 3144 - DNA, 60 bp, Pinus radiata
tctagagaattcaagtacctctctctacatcaaaaatttgtgagaaaataatcattatat

SEQ ID NO: 3145 - DNA, 60 bp, Pinus radiata
attctgaaataattagtgtcattctagtattaaaggctaatgttaccataggaattattg

SEQ ID NO: 3146 - DNA, 60 bp, Pinus radiata
tgaaggacatgataagttattcatagccctaatagtcgaagtacactgtctctagttaat

SEQ ID NO: 3147 - DNA, 60 bp, Pinus radiata
ggctggacaaggattgtaatctagtatattttcttggtctactttagttggcattatatt

SEQ ID NO: 3148 - DNA, 60 bp, Pinus radiata
tttgtggagtttttagaagtaggtttcttttcagtatttgtagaccgagaaagaacctga

SEQ ID NO: 3149 - DNA, 60 bp, Pinus radiata
gcattttagctttcttgcctacactgggaggacaatgataaatgtacactgtacagtagt

SEQ ID NO: 3150 - DNA, 60 bp, Pinus radiata
tcacagctggaaagtataattgtttcgtgagtatcttttaggaattctaggttcctgcct

SEQ ID NO: 3151 - DNA, 60 bp, Pinus radiata
ttccggtgggaaaagagggtgccacagggtcgtggctgtcttgtaatatagtatgattct

SEQ ID NO: 3152 - DNA, 60 bp, Pinus radiata
taaagttgttaaattttttgatcgcgagtgttcagaagttttaatagttaaatctattat

SEQ ID NO: 3153 - DNA, 60 bp, Pinus radiata
gattgtgttggtcctaactcttacaacttacgaagtccagaatttgaaagtctcatgact

SEQ ID NO: 3154 - DNA, 60 bp, Pinus radiata
tttggctagttaagagtgcctagtttagtagctttagggttagtgctctaacaattccga

SEQ ID NO: 3155 - DNA, 60 bp, Pinus radiata; identical to SEQ ID NO: 782

SEQ ID NO: 3156 - DNA, 60 bp, Pinus radiata
atctgtttggtcatatggcagtattttcttgccgtcggacttgaagctaactgttaaaac

SEQ ID NO: 3157 - DNA, 60 bp, Pinus radiata
ctcatcatcaaacttcagtccatgatacccattacttaccgtgccaatgcccgcctgcag

SEQ ID NO: 3158 - DNA, 60 bp, Pinus radiata
tgatgtaacctattaatttgtaagcggccagtacgcccctcccaaaccatggagacagtg

SEQ ID NO: 3159 - DNA, 60 bp, Pinus radiata
tttcagcatcagttactctcgggtcctttatacgagccttcattgggggctaagcgttgc

SEQ ID NO: 3160 - DNA, 60 bp, Pinus radiata
aatgttgaatgtactgattattcaacccatgcattcaggtacttttgactcttaggtttt

SEQ ID NO: 3161 - DNA, 60 bp, Pinus radiata
tttttaggtaattgttccattgttccacgaattgtaattgagttccatctacctctgatc

SEQ ID NO: 3162 - DNA, 60 bp, Pinus radiata
gatagagatttgtatagggagatgtggaatagcctagagctgtatgtgtgcagtgctata

SEQ ID NO: 3163 - DNA, 60 bp, Pinus radiata
ggttgaacacaaatgctttgttataacttataaacatcgccccttgtttaatggtgcatg

SEQ ID NO: 3164 - DNA, 60 bp, Pinus radiata
gtgaattatttagatggagggtaggccgctctgctttgtaaaatagtactatatttctgt

SEQ ID NO: 3165 - DNA, 60 bp, Pinus radiata
gaaaatgtaaggatagcctactgatatttcacatgcaaggagtgcaattagattattgat

SEQ ID NO: 3166 - DNA, 60 bp, Pinus radiata
tacatagatcgataggccactggaggtttcagacattcgaggaagagtttgagttttagt

SEQ ID NO: 3167 - DNA, 60 bp, Pinus radiata
gcacattgaaacatgatagtccctttcatggagctgcctaaagtaggttatttcctataa

SEQ ID NO: 3168 - DNA, 60 bp, Pinus radiata
tgaagtgtctagtttcgtacataaaccaagtgaggccgtaatgccatatataaattttag

SEQ ID NO: 3169 - DNA, 60 bp, Pinus radiata
tttactatttcgtattgcttaaaaggtttacattgttaccttacgtaaagtttttgtata

SEQ ID NO: 3170 - DNA, 60 bp, Pinus radiata
atgaactgacccaaacacgcaagccttctggcatcgtaagctacactgcctaggctttta

SEQ ID NO: 3171 - DNA, 60 bp, Pinus radiata
ggccatggcgatagacgaatttcagttaaattcgttgaacgatccgtgtatggatttcgg

SEQ ID NO: 3172 - DNA, 60 bp, Pinus radiata
tttatgtacagttattaatttatactctcatgttgaggggaatataggtaagcttaccaa

SEQ ID NO: 3173 - DNA, 60 bp, Pinus radiata
aatgatttgccctactatgacttatttatacatggttatccgatgtggctggctctttag

SEQ ID NO: 3174 - DNA, 60 bp, Pinus radiata
tcttcatttagtgtgcattttcttgaggattgtgcaggcagcgcagcctatttatcttct

SEQ ID NO: 3175 - DNA, 60 bp, Pinus radiata
gattattaggaaatagccctcccaagccagatgcaacgacaatcatgatgtttcaaaaca

SEQ ID NO: 3176 - DNA, 60 bp, Pinus radiata
aactatttagctgatgattgggattgaagttgtttatgctttaagcttgtactggtcatc

SEQ ID NO: 3177 - DNA, 60 bp, Pinus radiata
caaaagcattgtccgtgacatgagaaatgggattggtagcctttctaggagaagttttga

SEQ ID NO: 3178 - DNA, 60 bp, Pinus radiata
gtagagggtgcgccaacaattagttgcaggcaattattagaaatgatgtgtaagggtgct

SEQ ID NO: 3179 - DNA, 60 bp, Pinus radiata
atggactatgatgctgaggtttgagcgtatgtggtgaccaatatgcctagaaagaattaa

SEQ ID NO: 3180 - DNA, 60 bp, Pinus radiata
catatgccttagtacgttttgacacaaaacttgcttgtgaataggggaagatcagtcagt

SEQ ID NO: 3181 - DNA, 60 bp, Pinus radiata
caacccacaactcgaatgaatggtccactgaactatattgttaccaaataccagcgtgat

SEQ ID NO: 3182 - DNA, 60 bp, Pinus radiata
gagaaggatttaataagagtcgaatatatcttccagctcatatacccatgagctctcaaa

SEQ ID NO: 3183 - DNA, 60 bp, Pinus radiata
tccaacgcattacactaatgattcaacaactagcgttaacactagtgtagagtaaccctt

SEQ ID NO: 3184 - DNA, 60 bp, Pinus radiata
aaagtgatcactcacacatatgattttccttaatcagctagcataaaagtttgctatcct

SEQ ID NO: 3185 - DNA, 60 bp, Pinus radiata
acatcatgtgctgtacattttctgtgaaaattctatataattttatcacagttcatggtt

SEQ ID NO: 3186 - DNA, 60 bp, Pinus radiata
ggctgcataggttactcctgcaacaataacgtgaaggtggcaaatttctaatgtggatgt

SEQ ID NO: 3187 - DNA, 60 bp, Pinus radiata
tttgtagatatggtaaactgtaaaaggggatcgaatcgaatccatttgaggtttgattga

SEQ ID NO: 3188 - DNA, 60 bp, Pinus radiata
agatgatctcgtttgcataatgtgataaaaagagatccttgtggaggactatttcatagt

SEQ ID NO: 3189 - DNA, 60 bp, Pinus radiata
aagggactaacgtatgtatgtgcctaccattctgtattcttttcgacattggtgagtgtg

SEQ ID NO: 3190 - DNA, 60 bp, Eucalyptus sp.
tgacaagactgacagaaaacgtctgtttagtatgattaatgaccttccaaccatatttga

SEQ ID NO: 3191 - DNA, 60 bp, Eucalyptus sp.
actgttaccaacctgatttgcttagaatagtttatctatagatctactagactactctag

SEQ ID NO: 3192 - DNA, 60 bp, Eucalyptus sp.
ctgcacgagcgatgttcgaatgagttcagagctctcctctcagaagttattactttggag

SEQ ID NO: 3193 - DNA, 60 bp, Eucalyptus sp.
atcttcgaatgtaaatcatgtaccatgtacaaggcaaagagtgtgctcttgtaattctta

SEQ ID NO: 3194 - DNA, 60 bp, Eucalyptus sp.
catgtccataagctggtctactagtagtcttgtctcagtttctaggtatggcgtctccag

SEQ ID NO: 3195 - DNA, 60 bp, Eucalyptus sp.
ggttcgaaaaaggggtgtatgaaaggcaaaggtggtcccgagaatacgaccttcaattac

SEQ ID NO: 3196 - DNA, 60 bp, Eucalyptus sp.
ttttgggggtatttccatcactttacgacctctaatcttgtatcgcgttccgggaagaat

SEQ ID NO: 3197 - DNA, 60 bp, Eucalyptus sp.
ggtgggtcgctgttgtgggattatgactgagcgagtggatttactgttggtgagagagtt

SEQ ID NO: 3198 - DNA, 60 bp, Eucalyptus sp.
acaaagcgcaaaagtaggctgcgttcacagcaacatcgggcgttgtttatagttaataaa

SEQ ID NO: 3199 - DNA, 60 bp, Eucalyptus sp.
attgtttagagtgcattcttaatttatataggattcggtttgtttaattcctataaacca

SEQ ID NO: 3200 - DNA, 60 bp, Eucalyptus sp.
tccgagcaactatcgttggtaactaggacaaagttatgtccacatactaaacagttgtca

SEQ ID NO: 3201 - DNA, 60 bp, Eucalyptus sp.
tgttattttagtactttattagggtttagtggatgaaattaggggagattgacttggggg

SEQ ID NO: 3202 - DNA, 60 bp, Eucalyptus sp.
atccatcgaaacactcgttaaaaatggaaaattgattatcgggattgaactaaatccacc

SEQ ID NO: 3203 - DNA, 60 bp, Eucalyptus sp.
tgcagaatctagggaaagagggtcaaactaagcaaatttgctctactagaagtcgtacaa

SEQ ID NO: 3204 - DNA, 60 bp, Eucalyptus sp.
caagatcgaaacgccagcgtttattgttaaaacaagcaccacaagcatctagtctagctg

SEQ ID NO: 3205 - DNA, 60 bp, Eucalyptus sp.
aagtttatgatgattgggacttgttttagaccttgtgccgatgatatgcgagcgcattga

SEQ ID NO: 3206 - DNA, 60 bp, Eucalyptus sp.
ttgttgaaaaatctgtcttattacgtcaaaactgtagatgagtgaggccatgtctatctt

SEQ ID NO: 3207 - DNA, 60 bp, Eucalyptus sp.
agttggtgagtactgtgagagagaagggtacaatggatcagagtttgtacccacctatga

SEQ ID NO: 3208 - DNA, 60 bp, Eucalyptus sp.
tccttttcctctataattaataattgacttctttttattttaaaccattgcagcatgttc

SEQ ID NO: 3209 - DNA, 60 bp, Eucalyptus sp.
ggtttttgattgtcatcgagtcttatcaattcaactttctacttatcaaaaaattattcg

SEQ ID NO: 3210 - DNA, 60 bp, Eucalyptus sp.
tgagaattgatatgcattttaatgtaaattagtaaatgtaaactagttaatacgaggctt

SEQ ID NO: 3211 - DNA, 60 bp, Eucalyptus sp.
aattgagtctgtaagtttataccatttgtggctgttctgaacattaatatagtttctctt

SEQ ID NO: 3212 - DNA, 60 bp, Eucalyptus sp.
cattgcaaagttctggggtagatttatcccaggccagcatctcggtacaaattgatctag

SEQ ID NO: 3213 - DNA, 60 bp, Eucalyptus sp.
aggggatgaaattgccgcagctgcgaatcagattctaagcagcattcaagagtgagggtc

SEQ ID NO: 3214 - DNA, 60 bp, Eucalyptus sp.
tgtaaatgctgcctcctctggtatgcttaagcagaaagtaggtttagctagtttaatgtt

SEQ ID NO: 3215 - DNA, 60 bp, Eucalyptus sp.
tccaaaagcaggggcctgcctacatacccaggtcacttagtcctcaaagagaaatgacct

SEQ ID NO: 3216 - DNA, 60 bp, Eucalyptus sp.
gtccttcttttcctgaggaggaaactttgttattaaaaataatatcagctttttgccccg

SEQ ID NO: 3217 - DNA, 60 bp, Eucalyptus sp.
attgaaatttaggagtcattccatttaaaccgtcagaaagaatgagtactagcagtctac

SEQ ID NO: 3218 - DNA, 60 bp, Eucalyptus sp.
tcggaagtgctaacatatttttgtatatttagacagcactgacgaattctctatccgcaa

SEQ ID NO: 3219 - DNA, 60 bp, Eucalyptus sp.
ttgtaacatttcttccggtgcagagtgtgatagccatacatgtatcataatatataaatt

SEQ ID NO: 3220 - DNA, 60 bp, Eucalyptus sp.
cttggtagtgggtcgtgggaccttgtaaaagggattggttgtgtaaagtaccatttgtat

SEQ ID NO: 3221 - DNA, 60 bp, Eucalyptus sp.
ttggtcttacaatgctgtacagcttagagcaccgaatgtaaaataatatccccgagtagc

SEQ ID NO: 3222 - DNA, 60 bp, Eucalyptus sp.
gattttaatggtccaaccattggaaattacaattggttatgagtattatggtattataag

SEQ ID NO: 3223 - DNA, 60 bp, Eucalyptus sp.
ttctcttaaactaatcaagtgttactatggaattaggatgtgttaggttggattttactt

SEQ ID NO: 3224 - DNA, 60 bp, Eucalyptus sp.
tttgtttctcgttccgtggtctaaaatggtgtaagatactgaaataattggctaggagat

SEQ ID NO: 3225 - DNA, 60 bp, Eucalyptus sp.
attttagtgtttatatatccactgtcttatctgttcttgtcgtgtaaatgaatgtaatca

SEQ ID NO: 3226 - DNA, 60 bp, Eucalyptus sp.
acattctattggtactcgtggtcttagtgctgtggcaaatgtttctcctacaatcactgt

SEQ ID NO: 3227 - DNA, 60 bp, Eucalyptus sp.
ctcgctagatttattggctaccctgtcatgctggtttctggagtgtaacctaaccaacta

SEQ ID NO: 3228 - DNA, 60 bp, Eucalyptus sp.; identical to SEQ ID NO: 1679

SEQ ID NO: 3229 - DNA, 60 bp, Eucalyptus sp.
ttcttagttgtgtatcgctgtgagaattgtgatttttaagcagttttgtaagtatttgta

SEQ ID NO: 3230 - DNA, 60 bp, Eucalyptus sp.
ttcctgcaacttttcattggggtattgttgttctgtgcctctggctttattctgaatctg

SEQ ID NO: 3231 - DNA, 60 bp, Eucalyptus sp.
gcttatctaaatacacgtccacttcgtggagacctgggggtagctagagttctgtgttaa

SEQ ID NO: 3232 - DNA, 60 bp, Eucalyptus sp.
tctcagcgtgtggcctgtttttaggatgattgaaagctaagatatcgaataggggtcaaa

SEQ ID NO: 3233 - DNA, 60 bp, Eucalyptus sp.
ggggatttaggttggggatataagtattccctgaataggttttaaattacaggttacata

SEQ ID NO: 3234 - DNA, 60 bp, Eucalyptus sp.
ggttcgttgtaatatgtttcgctgggggtgtgacgtttgtgttgtaggtgagcgttccgt

SEQ ID NO: 3235 - DNA, 60 bp, Eucalyptus sp.
gcaattccatgttctggtagggggttagataacttcagcgacgaacgttcgtgtggatct

SEQ ID NO: 3236 - DNA, 60 bp, Eucalyptus sp.
attttcattcagtaaacatttctgtatagcacagggatatcctgtacatcgttgcagaga

SEQ ID NO: 3237 - DNA, 60 bp, Eucalyptus sp.; identical to SEQ ID NO: 1688

SEQ ID NO: 3238 - DNA, 60 bp, Eucalyptus sp.
gctgatccatagtttatgatactattgttttgacacggttcgtggtccaagagtcaaaaa

SEQ ID NO: 3239 - DNA, 60 bp, Eucalyptus sp.
aggctcattccaagacttgtgggactagagaatacaaatgtgactgcggcactatattct

SEQ ID NO: 3240 - DNA, 60 bp, Eucalyptus sp.
ttactacaattcttctcactgcttctactctcgctatgactacaatcacgtctacagcgc

SEQ ID NO: 3241 - DNA, 60 bp, Eucalyptus sp.
atgatatttcggagagaccttcatcgggacatgggggagatgattttaagggagcggcga

SEQ ID NO: 3242 - DNA, 60 bp, Eucalyptus sp.
agagagtgtcgtcgtgtatttggattaacgtattcgatctataaatcaattatgaatcgt

SEQ ID NO: 3243 - DNA, 60 bp, Eucalyptus sp.
taagagggatgctaatttacgcatgcacatgagaggtcatggggatgaatacaaaacacc

SEQ ID NO: 3244 - DNA, 60 bp, Eucalyptus sp.
tttatctgtcatgtttttatggcctaatatacacgtgcatgtaagtttccgttagagatt

SEQ ID NO: 3245 - DNA, 60 bp, Eucalyptus sp.
ttttgttatgggactcaacttaagttccctttgtttcgcaaaatttcaatttactgaatt

SEQ ID NO: 3246 - DNA, 60 bp, Eucalyptus sp.
tgaaggatagacttgatcctttatatactatttacgatatacccatacaaggaatacaat

SEQ ID NO: 3247 - DNA, 60 bp, Eucalyptus sp.
ctactactacatctacgataccttaaggggacaggtgattcgatagtaatgtgtaggttc

SEQ ID NO: 3248 - DNA, 60 bp, Eucalyptus sp.
ccgagctacgcaagactgcactctgaagaattctgtggagttttgagggtgcaattgtaa

SEQ ID NO: 3249 - DNA, 60 bp, Eucalyptus sp.
tttcgtaaaggcatacaacacacaaagtaatgcagacctcagtctcaatggtcctgtcgg

SEQ ID NO: 3250 - DNA, 60 bp, Eucalyptus sp.
agcttttcccgtggtattggccctttatggaatttggaaacacaaggtggggcatttgtg

SEQ ID NO: 3251 - DNA, 60 bp, Eucalyptus sp.
gttctttcttcataagcgtcttgcttgtcgatctgtaaattattgaaaagggtcatggaa

SEQ ID NO: 3252 - DNA, 60 bp, Eucalyptus sp.
ttattaaattcattctaagatgtagctagaaggttgattaagctcacatgacaatcgagt

SEQ ID NO: 3253 - DNA, 60 bp, Eucalyptus sp.
tggcatgtgatgaccacgtgtgatccttcttgtgacgttcgttatagtggggatattcgc

SEQ ID NO: 3254 - DNA, 60 bp, Eucalyptus sp.
ctttgcatgtaattgagaggtagcaattgtctcggattgtagagtattgaaatttgatgc

SEQ ID NO: 3255 - DNA, 60 bp, Eucalyptus sp.
gatattcttgatatattcctcatgtctcatattagcgaatatcgtgtgtacaacttcaaa

SEQ ID NO: 3256 - DNA, 60 bp, Eucalyptus sp.
caccagtcgatccttattacggtgggcttctgactgcatacagaccacaggctattattc

SEQ ID NO: 3257 - DNA, 60 bp, Eucalyptus sp.
catgctacatggcatggctttaggctttgagaccttgatgcccaataaaagtataatatc

SEQ ID NO: 3258 - DNA, 60 bp, Eucalyptus sp.
aagatgtagggaaaattgcattagcagttcctgttctagtctctaaagcattagaattat

SEQ ID NO: 3259 - DNA, 60 bp, Eucalyptus sp.
ttctgtctagatttaatcatcttctccaactttgctgtatgctgttagtattcactagtt

SEQ ID NO: 3260 - DNA, 60 bp, Eucalyptus sp.
gtcatttccctattacccagttggcttatgcttacaacaaggtctcatgtcttcacctca

SEQ ID NO: 3261 - DNA, 60 bp, Eucalyptus sp.
ggactcatgttgctactggtatgctactaggagatggtatgctagggccctaatctaggt

SEQ ID NO: 3262 - DNA, 60 bp, Eucalyptus sp.
aaacctgcataaggtctaaagccagaagtagaaatataggcgcacatttacatagtttcc

SEQ ID NO: 3263 - DNA, 60 bp, Eucalyptus sp.
ctttactcaggcaagtccggtgaaaacgagaatcgactcttttcccctacccacaaaaag

SEQ ID NO: 3264 - DNA, 60 bp, Eucalyptus sp.
tcttcgtggattcggacaaactaataaacaatatggccgcggctctagaaagatcacctg

SEQ ID NO: 3265 - DNA, 60 bp, Eucalyptus sp.
catgaggttatgtaacactactgactttttatcgaatgtgaggttgtccaatactcccaa

SEQ ID NO: 3266 - DNA, 60 bp, Eucalyptus sp.
tgattcaactagacaagtcgttggtgcactacttcgaaattgtggttacgaagttacagc

SEQ ID NO: 3267 - DNA, 60 bp, Eucalyptus sp.
gatcagatcatccccttttatataattcatggtagtcggtagtaccacttcggctatata

SEQ ID NO: 3268 - DNA, 60 bp, Eucalyptus sp.
gttgtttagattttaccaattggtaattaactcccatgtgtagactctacttaaggacat

SEQ ID NO: 3269 - DNA, 60 bp, Eucalyptus sp.
gagactgttataattaatagcccgagggatcaggtactaaagctagtacatcgaatcagg

SEQ ID NO: 3270 - DNA, 60 bp, Eucalyptus sp.
aagagaatcccattcccccacccaagcaattgagtaataaaagaaagatgtttggatttg

SEQ ID NO: 3271 - DNA, 60 bp, Eucalyptus sp.
gaagtctagattgacgatggcagggtttaggcaataccctctaagtagttatgttaattc

SEQ ID NO: 3272 - DNA, 60 bp, Eucalyptus sp.
gaggaatgttatctatatatagtttgatcgagtgctcacaattcatagtgcaccagtccc

SEQ ID NO: 3273 - DNA, 60 bp, Eucalyptus sp.
ccatatagattactcccaaggcatgttttctaacttgacgactggcaattggtgagattc

SEQ ID NO: 3274 - DNA, 60 bp, Eucalyptus sp.
ttcaatgtcccgttcaagtttaatactatagtgaaaggttgggatgccattaaagttgag

SEQ ID NO: 3275 - DNA, 60 bp, Eucalyptus sp.
attcaagattcctgtggagttcaggggactaagtgtttcttccccggatgtcactagaga

SEQ ID NO: 3276 - DNA, 60 bp, Eucalyptus sp.
atttaattagacccgtcttgtaatacgatttcggactataactgggaagggggatttagt

SEQ ID NO: 3277 - DNA, 60 bp, Eucalyptus sp.
tctttcactactctgcgttgttcgatgcatttgatactaatttagggagggataaccaga

SEQ ID NO: 3278 - DNA, 60 bp, Eucalyptus sp.
ttttctaacagttagtggcagaatctgagttcacacaattacattagggagatgtacttc

SEQ ID NO: 3279 - DNA, 60 bp, Eucalyptus sp.
aacgagaggacctcagagtgcgacctggcgaagctatagccgtgaattttccctttgttt

SEQ ID NO: 3280 - DNA, 60 bp, Eucalyptus sp.
ctgattatgggtatgggtgcgggattatcatgtacagtttatgttattcgcctgatggct

SEQ ID NO: 3281 - DNA, 60 bp, Eucalyptus sp.
gagatgacagtgcggaggttagtgctagatgctgtagatggtttaaataggaaagttgtc

SEQ ID NO: 3282 - DNA, 60 bp, Eucalyptus sp.
gttggcattttgctggctattaaacacctttatttactcacggtgataggagagcgtgga

SEQ ID NO: 3283 - DNA, 60 bp, Eucalyptus sp.; identical to SEQ ID NO: 2697

SEQ ID NO: 3284 - DNA, 60 bp, Eucalyptus sp.
gaacacttcttcgatcgtgaaatatgtaatcttcatttgctcagtaatatagtgattttt

SEQ ID NO: 3285 - DNA, 60 bp, Eucalyptus sp.
ccactggtttagaccagaaacagataaacaattggttcataaatcatgttatagagtgtt

SEQ ID NO: 3286 - DNA, 60 bp, Eucalyptus sp.
tatgattggtggcctgatttgacatttgagagacgtgatgaagatgatgacgtgggttta

SEQ ID NO: 3287 - DNA, 60 bp, Eucalyptus sp.
gagcaatgaccatcgaagtcctatcaactggtgttgccgggaattacaatggggcattgc

SEQ ID NO: 3288 - DNA, 60 bp, Eucalyptus sp.
agcaaacgcaagaggtgatccggataaagagagacctatgtaaagcaacgtcaaaagcca

SEQ ID NO: 3289 - DNA, 60 bp, Eucalyptus sp.
gaagtcaggtctcgaattggttcatcaatgcaagagtgcgtctctggaaacctatggtcg

SEQ ID NO: 3290 - DNA, 60 bp, Eucalyptus sp.
agagattactaccgaactgagtcaacatggacaaatttcagaaacgaatgtctataactg

SEQ ID NO: 3291 - DNA, 60 bp, Eucalyptus sp.
tgatccaactgttgccatgtattccaaatgtttagttttgctttttaagtgcataccacc

SEQ ID NO: 3292 - DNA, 60 bp, Eucalyptus sp.; identical to SEQ ID NO: 1744

SEQ ID NO: 3293 - DNA, 60 bp, Eucalyptus sp.
tctatattgtaacagatgtatagtagctaggacatcattatttggtgtgggactatgact

SEQ ID NO: 3294 - DNA, 60 bp, Eucalyptus sp.
cagccgcttgttaaacataatctttaaggcgagaaccttgcatagttatactagttttgg

SEQ ID NO: 3295 - DNA, 60 bp, Eucalyptus sp.
aacaaaaacagacgcacttgatcaccgtcttagctcaattaatgcagaagccagtatttg

SEQ ID NO: 3296 - DNA, 60 bp, Eucalyptus sp.
tttccagttttgttcggcagctaaatacttatgtgggtatttgctggaacacggccttca

SEQ ID NO: 3297 - DNA, 60 bp, Eucalyptus sp.
tcccctccgggatagcttagttactgtagaagtatgattaattatcggcgtaagaacaca

SEQ ID NO: 3298 - DNA, 60 bp, Eucalyptus sp.
tgatattcatcggtgctgtaggaacactgtaaacacgttcttttcacctgcataggctgc

SEQ ID NO: 3299 - DNA, 60 bp, Eucalyptus sp.
aaaaggcctctgtagaatctcgaaggcgattctccaggagaggtggtcaatctcagcgtt

SEQ ID NO: 3300 - DNA, 60 bp, Eucalyptus sp.
ttcttcattttggttttgctcaacattctagcatctcattctcaattcttctggtatata

SEQ ID NO: 3301 - DNA, 60 bp, Eucalyptus sp.
aatctccagtctaatgtacagctaggcctggattttgtgtctcctgaaagcttgggagaa

SEQ ID NO: 3302 - DNA, 60 bp, Eucalyptus sp.
tttttaaataacatgtaaagacatttttacctgtccatgtactcatggtaacggatattt

SEQ ID NO: 3303 - DNA, 60 bp, Eucalyptus sp.
cgtcgatttaaatgtacacccgtttgtgtgttaagaaagtgcgttttcgtcagtgactgc

SEQ ID NO: 3304 - DNA, 60 bp, Eucalyptus sp.
caagctctatgatttctccagctccaggcagatgaagggagaggatctggaggggttaaa

SEQ ID NO: 3305 - DNA, 60 bp, Eucalyptus sp.; identical to SEQ ID NO: 2726

SEQ ID NO: 3306 - DNA, 60 bp, Eucalyptus sp.
tgttgatgcgaaacatagagcgcatatggaataagatatgtgtatgcattgatataattg

SEQ ID NO: 3307 - DNA, 60 bp, Eucalyptus sp.
taaagcagattcgatccactcgaacacagtatatgctggaccagctcactgaccttcaac

SEQ ID NO: 3308 - DNA, 60 bp, Eucalyptus sp.
acagtaatgtatgtgtgcgtactcatttctattacgaccatactgaagcggtagtgtcgt

SEQ ID NO: 3309 - DNA, 60 bp, Eucalyptus sp.; identical to SEQ ID NO: 1761

SEQ ID NO: 3310 - DNA, 60 bp, Eucalyptus sp.; identical to SEQ ID NO: 1762

SEQ ID NO: 3311 - DNA, 60 bp, Eucalyptus sp.
aagcaacaggtatgcaactggtcctagagtttactgtcccctgtagttcgtgaactcaaa

SEQ ID NO: 3312 - DNA, 60 bp, Eucalyptus sp.; identical to SEQ ID NO: 1764

SEQ ID NO: 3313 - DNA, 60 bp, Eucalyptus sp.; identical to SEQ ID NO: 1765

SEQ ID NO: 3314 - DNA, 60 bp, Eucalyptus sp.
tcagacagctaactggtgcgtcttctactagcaaacaataaagggtggaagcgcattatt

SEQ ID NO: 3315 - DNA, 60 bp, Eucalyptus sp.
agcttttgcgtaatcatcagtgttctcaatttgcaaaataccattaacggatcttgcagc

SEQ ID NO: 3316 - DNA, 60 bp, Eucalyptus sp.
gaagatgtagcgctttagttataaaatctggtgccatgtagatatctgcgtattctcaga

SEQ ID NO: 3317 - DNA, 60 bp, Eucalyptus sp.
caattatccccatatttgttcccaaagcctctactcggatcgtcctttttgctcgcagac

SEQ ID NO: 3318 - DNA, 60 bp, Eucalyptus sp.
aaatcacaccctttgtatcagcatatacgacatacgagcacgtagggacgtgcgtttgga

SEQ ID NO: 3319 - DNA, 60 bp, Eucalyptus sp.
tccccaatgaggctgtaacatccaggaatactcttataactctagggtacttagtgaccc

SEQ ID NO: 3320 - DNA, 60 bp, Eucalyptus sp.
aaagtggatgtcagcctacccatcccctgtgtaatttcattgtatcgtgtctagtgggaa

SEQ ID NO: 3321 - DNA, 60 bp, Eucalyptus sp.
gcttttgggaattactagattcgtaattaaacttgtgtagtccatgtagttgacagattt

SEQ ID NO: 3322 - DNA, 60 bp, Eucalyptus sp.
agtttcattatttgacaagtaacacgttaggaatcagactttcggagtgatcgctaagca

SEQ ID NO: 3323 - DNA, 60 bp, Eucalyptus sp.
atggtgtttttcccaagtgccaaaaacacttggagcggagaactcaccctggtgactgca

SEQ ID NO: 3324 - DNA, 60 bp, Eucalyptus sp.; identical to SEQ ID NO: 2793

SEQ ID NO: 3325 - DNA, 60 bp, Eucalyptus sp.; identical to SEQ ID NO: 2788

SEQ ID NO: 3326 - DNA, 60 bp, Eucalyptus sp.
ttcccttagcttatgtacaaaagcaaacaatgactcctacttaaaccttctaattaattc

SEQ ID NO: 3327 - DNA, 60 bp, Eucalyptus sp.
ctccaaacgtctccgtttctctccagctgaaacatggacaagaagccagacgacgacaat

SEQ ID NO: 3328 - DNA, 60 bp, Eucalyptus sp.
gcactaatagaaccgtccagagagtccgtcgataataataactacatgagtaggccggtt

SEQ ID NO: 3329 - DNA, 60 bp, Eucalyptus sp.
ttgtgctagcaagcgctcatgcacaatgattgaccataacgtgtagttatctagttgtaa

SEQ ID NO: 3330 - DNA, 60 bp, Eucalyptus sp.
gataattgtataagaggaccaataattcgaatgaagaaagtactttttgcttgctttctt

SEQ ID NO: 3331 - DNA, 60 bp, Eucalyptus sp.
gatatggcattagatcaggatgctttgttctaactcaactagatctcaattagggaaatg

SEQ ID NO: 3332 - DNA, 60 bp, Eucalyptus sp.
gcttcacgagactttgtccatcgtacaccatgtgtaaaagagtttcgcttgcaacacatt

SEQ ID NO: 3333 - DNA, 60 bp, Eucalyptus sp.; identical to SEQ ID NO: 2804

SEQ ID NO: 3334 - DNA, 60 bp, Eucalyptus sp.
cgagttcataggggaacctcgatgattaacgtcgatgcttgctaatattgcagcttgatg

SEQ ID NO: 3335 - DNA, 60 bp, Eucalyptus sp.
agtattagttatgcatattatgattgattatctccgtttggatgtgcatatctaggctgt

SEQ ID NO: 3336 - DNA, 60 bp, Eucalyptus sp.
gttttctatgaacatatagattgttttctgcctgtaggatacaggtttcgccccaccgat

SEQ ID NO: 3337 - DNA, 60 bp, Eucalyptus sp.
tggtatgtgtaatcgttgatggaatacacagaatatggatagagtcagagtggatacggg

SEQ ID NO: 3338 - DNA, 60 bp, Eucalyptus sp.
atcatataaaaccaaatatcggcagtctcgcgtgcacgtaatgggtttgccttatatatc

SEQ ID NO: 3339 - DNA, 60 bp, Eucalyptus sp.
gagcattaattagtatgccaaacttgagtgatgttgccagtgtttggggacatttataaa

SEQ ID NO: 3340 - DNA, 60 bp, Eucalyptus sp.
tgaacaccccttatttaacattctgaacttctaatttgttgatcgaccagagtctaattc

SEQ ID NO: 3341 - DNA, 60 bp, Eucalyptus sp.
gatggttgtccgtttatagatgggcatagtgacgaattgtatgatctgctatattccccg

SEQ ID NO: 3342 - DNA, 60 bp, Eucalyptus sp.
cttggactttgttgtgagaatcgaatagatgggagaggatcagtttagctgtacaatttg

SEQ ID NO: 3343 - DNA, 60 bp, Eucalyptus sp.
ctactgtttgctgctaatatatatgagagcccattttgtattattagcttatagtggtag

SEQ ID NO: 3344 - DNA, 60 bp, Eucalyptus sp.
gagatagtggataaactcacataggaacatactattctagttatcattatgtaggaccct

SEQ ID NO: 3345 - DNA, 60 bp, Eucalyptus sp.
ttcgtaaattatacatgatctagctgattacactatcagttgatttacaaaactatattc

SEQ ID NO: 3346 - DNA, 60 bp, Eucalyptus sp.
tgcttcttgcttagttgatggatgtgattcggaccttagtaagtgcagagactatcatcg

SEQ ID NO: 3347 - DNA, 60 bp, Eucalyptus sp.
tcatttgctcaatgggtaggtagctcctatgtttctctcatattcagtttgctttgtcaa

SEQ ID NO: 3348 - DNA, 60 bp, Eucalyptus sp.
aaagctaaagggagcgtttttggcttcgaattatggctcaaatcggacattctatcatga

SEQ ID NO: 3349 - DNA, 60 bp, Eucalyptus sp.
tcttgttagtgtcgtctctaggaatccctgttaatgaatgatttaggtgagttcgactct

SEQ ID NO: 3350 - DNA, 60 bp, Eucalyptus sp.
tctttcaccaactccacaattcctagaaatttttatggaatttcctagaaaataagttag

SEQ ID NO: 3351 - DNA, 60 bp, Eucalyptus sp.
tcttatctgttatagggcctcaatgaattggatagtgatatataatatttacaagtgaat

SEQ ID NO: 3352 - DNA, 60 bp, Eucalyptus sp.
gaaaatctaaatatgtcatggactacaggtaccctttgacaggttatcaggcattctgca

SEQ ID NO: 3353 - DNA, 60 bp, Eucalyptus sp.
tctggtagatactgatcatacgtatataagggtattcgtatattcaccagggtcgagcaa

SEQ ID NO: 3354 - DNA, 60 bp, Eucalyptus sp.
acaacgggccctaatcaagtcgattggagtgcattctaatataaatagtacagccgatgt

SEQ ID NO: 3355 - DNA, 60 bp, Eucalyptus sp.
agagagactgcacagtatagtaatactaaataatacacctcctttagacttgactgaaga

SEQ ID NO: 3356 - DNA, 60 bp, Eucalyptus sp.
gagagctcagtagtcacagatagccttgtactgtatgcaactattgttgtagtataacca

SEQ ID NO: 3357 - DNA, 60 bp, Eucalyptus sp.
gattgctttttcgagccctgagtcttcagcgtcttaggttttattaattggcttgaactg

SEQ ID NO: 3358 - DNA, 60 bp, Pinus radiata
tccagtgctatccatgacaactaatatggagcatatcaacacacgagataagtcctggca

SEQ ID NO: 3359 - DNA, 60 bp, Pinus radiata
tggaggatttagcttgctaattcttttagcttccagaaacctgctgtatctatatagaat

SEQ ID NO: 3360 - DNA, 60 bp, Pinus radiata
ttctccaagttttctcttcagtttcatgtacagttttgaatccaatttagatgtaaacat

SEQ ID NO: 3361 - DNA, 60 bp, Pinus radiata
tgatgatttgtttaacgcattgcaattatccaggcaaagcatctagatgggataattgtt

SEQ ID NO: 3362 - DNA, 60 bp, Pinus radiata
cgagcttacgacgtcgctgagttctacctgaagggcaagaagcaggcattgcttaatttt

SEQ ID NO: 3363 - DNA, 60 bp, Pinus radiata
gtttcagagtttttgcagtgcgtctaaatggcggtagaaaccatgcggatgtcgagggtg

SEQ ID NO: 3364 - DNA, 60 bp, Pinus radiata
ctcattcctggatcttgacaattctgagctaaattgggactcagcgctggactatgattt

SEQ ID NO: 3365 - DNA, 60 bp, Pinus radiata
gtatattggtacataatacttacaagtaggtggacattgtcaatatctattcatcgtatt

SEQ ID NO: 3366 - DNA, 60 bp, Pinus radiata
tttgacttgagccgctacatgtctcgtctccgtccagcgaaagatataataaatagcgat

SEQ ID NO: 3367 - DNA, 60 bp, Pinus radiata
ccgcgaattaacgcagccgatggtctctaccgatatttcatcctgcaaccgcaagatcaa

SEQ ID NO: 3368 - DNA, 60 bp, Pinus radiata
gttcatgtgttcgttaaaggaggactggctttcactcttcacgcaaaataacgactcaga

SEQ ID NO: 3369 - DNA, 60 bp, Pinus radiata
tcttagacaaccaagacctctgtcctgaacaagtccctgcgatgtttccagtgccctttg

SEQ ID NO: 3370 - DNA, 60 bp, Pinus radiata
aaaacgttcttgccacctggcatgagcagtgtcggacgacaactatccaaccttcaataa

SEQ ID NO: 3371 - DNA, 60 bp, Pinus radiata
ggcaaatcagctcctttttggctttgccaagatatggcaataacctctcaacaacatcat

SEQ ID NO: 3372 - DNA, 60 bp, Pinus radiata
gatgtacttcagttcataactcttaggtatgccccataatatgttcgtccaggatatcta

SEQ ID NO: 3373 - DNA, 60 bp, Pinus radiata
gaatcaactgtacgaaggtacatgggtacaattactggcataggtgacttggatcctgct

SEQ ID NO: 3374 - DNA, 60 bp, Pinus radiata
tgcatactctgggcccctggggtattgagtattaattactgtatcataaaactagtttgc

SEQ ID NO: 3375 - DNA, 60 bp, Pinus radiata
aatagtttcagacgggggtactgttttatttttagtactgtaacagtacataactgttac

SEQ ID NO: 3376 - DNA, 60 bp, Pinus radiata
tcattaggaaggcctaacgttgctcctttctcagatgtattgagtaataaaggcaagttt

SEQ ID NO: 3377 - DNA, 60 bp, Pinus radiata
ctgtagtgatcccatggctatcgtatgctggcattagacctaacggagcagtattagctg

SEQ ID NO: 3378 - DNA, 60 bp, Pinus radiata
ttaattcaaattgaacttccgagtttgaatttagtgactggaaaacatagcactgtattt

SEQ ID NO: 3379 - DNA, 60 bp, Pinus radiata
caagcttataggattagacagtttagttatctgcaatttgccttctgtacgagtttcatt

SEQ ID NO: 3380 - DNA, 60 bp, Pinus radiata
cattttgctcgatgcttgtgaatggttttgccatcacagaaacgttatataatgctcatt

SEQ ID NO: 3381 - DNA, 60 bp, Pinus radiata
cagagggtattaccatacagctattttaggtatagacttctatgtgtattggaatggttc

SEQ ID NO: 3382 - DNA, 60 bp, Pinus radiata
gttgttgtgcttaggtggactatttatctattgtgatggtattgatgaatacctggattc

SEQ ID NO: 3383 - DNA, 60 bp, Pinus radiata; identical to SEQ ID NO: 3145

SEQ ID NO: 3384 - DNA, 60 bp, Pinus radiata
cagcgcaaaccatggagtcactcttctgttcgtctccttatattgtatattattaattcc

SEQ ID NO: 3385 - DNA, 60 bp, Pinus radiata
cacaaaagatctagctgccacatggtgatagtgtcaattaaacgatgcaaattgcatatt

SEQ ID NO: 3386 - DNA, 60 bp, Pinus radiata
catgtttgctacagctgaatttagttaaagattagtgacggttaatctgactccatagcc

SEQ ID NO: 3387 - DNA, 60 bp, Pinus radiata
tttgtccttggccttcgcattatgtatatgaggtatttttaaccgagccatagtataaag

SEQ ID NO: 3388 - DNA, 60 bp, Pinus radiata
aatatgtatatgtctgagaaaagcagatcctacctgcaaaagatgctatactgctttttc

SEQ ID NO: 3389 - DNA, 60 bp, Pinus radiata
gggcagctgcaggcattactttcttaaatgaaactatcattatttcatttgaacacttgg

SEQ ID NO: 3390 - DNA, 60 bp, Pinus radiata
aattcaatgcataggtaacttggacagggttcttccagttatttgctttgagtaataaaa

SEQ ID NO: 3391 - DNA, 60 bp, Pinus radiata
ttggccgagaggcgataataagaattcagtgtactaaacataatcatcctgttgcgagac

SEQ ID NO: 3392 - DNA, 60 bp, Pinus radiata
tgtaactgtttaggcattccccaaagcaagattctggggacctaaaagcgtctaatacca

SEQ ID NO: 3393 - DNA, 60 bp, Pinus radiata
ataagtaggcgcataacatatagagcacatcttgaattattaattcctaaacggcgctct

SEQ ID NO: 3394 - DNA, 60 bp, Pinus radiata
catgatgctgtatatattgtaggtgaggcgttttgttcacgattttaatgttctggtcag

SEQ ID NO: 3395 - DNA, 60 bp, Pinus radiata
atccaatttaactgcttttgtgactatctagatacacctggtgctctcgagaattcagct

SEQ ID NO: 3396 - DNA, 60 bp, Pinus radiata
atattatgtatcaacattgttagatatgcatgtgataacattgaacgtactgctctattc

SEQ ID NO: 3397 - DNA, 60 bp, Pinus radiata
ggattcagaccatggtatgtattccaactcctaatggcgttgtggaattgggttctatgg

SEQ ID NO: 3398 - DNA, 60 bp, Pinus radiata
aagagggaaattagcaggtcgtaggttgttttaacattcacctctccaattcaattactg

SEQ ID NO: 3399 - DNA, 60 bp, Pinus radiata
caagagctttaaccctttaaaatgtgtgcttgttttttccggttaattattccatagaaa

SEQ ID NO: 3400 - DNA, 60 bp, Pinus radiata
tttaggaatgtatatcgagtgatcgactagtccaagtttgtcagagatgctttgtggcta

SEQ ID NO: 3401 - DNA, 60 bp, Pinus radiata
agacaaataatgtagactttatggacctcgattataagccccctctttgcaatgtttccc

SEQ ID NO: 3402 - DNA, 60 bp, Pinus radiata
aaaccatgtctcccccccttaactcggatcgtagttgcggtttcgatttataaaagtgat

SEQ ID NO: 3403 - DNA, 60 bp, Pinus radiata; identical to SEQ ID NO: 2926

SEQ ID NO: 3404 - DNA, 60 bp, Pinus radiata
ggaataataacaataatattggtaccagtagtgctcaacctaccagtggtggtggtttca

SEQ ID NO: 3405 - DNA, 60 bp, Pinus radiata
gcttgaacgatggaaaaggtacatgatagtggctgttatcaatgtacaaaagttggcaac

SEQ ID NO: 3406 - DNA, 60 bp, Pinus radiata
ccaacaacattaattgggcgaggttgagattagtccattgctcagagggagctaaaggat

SEQ ID NO: 3407 - DNA, 60 bp, Pinus radiata
acactactgcaggtttttattttgggatgcttgtggttatggagtatgaactaagtattc

SEQ ID NO: 3408 - DNA, 60 bp, Pinus radiata
gctttctgccatgagtttttagtaattactaacgaaattctatcgaacttcttgattctc

SEQ ID NO: 3409 - DNA, 60 bp, Pinus radiata
atgttactaacaggtttctcctgtcattcatgaatgttggctccagaacgtagatgtagc

SEQ ID NO: 3410 - DNA, 60 bp, Pinus radiata
ggtgtcctgtgttctttaaatagcgtaacatgttatcagttgtttctcaaactgtactgc

SEQ ID NO: 3411 - DNA, 60 bp, Pinus radiata
aaaacttgtatagggccccgaagtattcatacattaacaattctcgtatagggccctggt

SEQ ID NO: 3412 - DNA, 60 bp, Pinus radiata
tcagtgtgatatggatgtccatgtaggtggcaagagaacccacgtaagatatctattgct

SEQ ID NO: 3413 - DNA, 60 bp, Pinus radiata
atggtcacgagctataaattgctagaaaacatgataaatgagggtataataaagcggcaa

SEQ ID NO: 3414 - DNA, 60 bp, Pinus radiata
ttcactctattgataacggatgtaagctgatataagcactctttgattagtagaaaagtg

SEQ ID NO: 3415 - DNA, 60 bp, Pinus radiata
atgacgccgataaataataatagcagcagcaactagcacaagttagtactgcgttttcgg

SEQ ID NO: 3416 - DNA, 60 bp, Pinus radiata
acaatgtaagttacatattctctgatctcacaatgtaaatgcagcatctaagcgttttca

SEQ ID NO: 3417 - DNA, 60 bp, Pinus radiata
tcctgtaagcttttcagacttttttcaatgaatgcagagagattaaaacctaaaacctaa

SEQ ID NO: 3418 - DNA, 60 bp, Pinus radiata
atcatgaagccatgtgaaggcgggagaatctacctatgaattctgaatgaggaatatttt

SEQ ID NO: 3419 - DNA, 60 bp, Pinus radiata
tttcatcgtcattttccctcgaggttcttgatcagtcggtaccgaacacgagagaatttt

SEQ ID NO: 3420 - DNA, 60 bp, Pinus radiata
tagtgtatttaatcacggctagcgcaatgttttgtattcagtcaatacgggcactgtcca

SEQ ID NO: 3421 - DNA, 60 bp, Pinus radiata
aaccataaacgttacatttattagcaaaatcagcgctcaatatacagcacagagtccgaa

SEQ ID NO: 3422 - DNA, 60 bp, Pinus radiata
gcttcttagaatgccacatcaagattatcactggaaattgacctgttaagttttcataac

SEQ ID NO: 3423 - DNA, 60 bp, Pinus radiata
taggtcataattaatgtgtcgaattttgttgatgaggtggctcatcaaataggacggcta

SEQ ID NO: 3424 - DNA, 60 bp, Pinus radiata
tgataagatggtcttatgtaatgagtagagattggttgatctggccaggcctgtatatta

SEQ ID NO: 3425 - DNA, 60 bp, Pinus radiata
gagaattgcctcaactgaattgcctcaattgagtgagaattactcattaggtatgtacaa

SEQ ID NO: 3426 - DNA, 60 bp, Pinus radiata
tgaagcctcaagagggttggtaagcccaaggcttatgactttatctgatactacttccca

SEQ ID NO: 3427 - DNA, 60 bp, Pinus radiata
aaggctattatgctcagggatttgcctaaaaccataagtggccttagataaggtaccatt

SEQ ID NO: 3428 - DNA, 60 bp, Pinus radiata
ttaccttagggaataattattacctagtctagtgaactactgctgctactactgctatta

SEQ ID NO: 3429 - DNA, 60 bp, Pinus radiata
tgtatagtatttgtattggaagtgccagtgatgggaatgacgaaaatggtcaatgaaaca

SEQ ID NO: 3430 - DNA, 60 bp, Pinus radiata
agtgagtgacttctgaggttgtatatggaaaaacctatgatgttggctgtctactgctat

SEQ ID NO: 3431 - DNA, 60 bp, Pinus radiata
gcaatttaatctgtccgtacaaaatcattcaggctaacattcaattcgatcttggtgttg

SEQ ID NO: 3432 - DNA, 60 bp, Pinus radiata
tgtagctaagtcttactttatatgtcatgtttcaccgagcataataataagtggctaatt

SEQ ID NO: 3433 - DNA, 60 bp, Pinus radiata
ttttatgggtcatgtggggacagctggtgccttagttaaagtagaatggcatcaccaacc

SEQ ID NO: 3434 - DNA, 60 bp, Pinus radiata
agacatttaacactctaataatggtaggacaatcgacctttcaataacctatagcgtgct

SEQ ID NO: 3435 - DNA, 60 bp, Pinus radiata
gtttattgtgcctcatagctagaaagctaagatgctactttactgactattctttactta

SEQ ID NO: 3436 - DNA, 60 bp, Pinus radiata
tgatcgaaggataagagtttattgcagtttgcaatctcttaaggatgttatgttcagctg

SEQ ID NO: 3437 - DNA, 60 bp, Pinus radiata
agcaaaactgttacagttcctttatcggtgccaccgtcagctagttcaggggccttagtg

SEQ ID NO: 3438 - DNA, 60 bp, Pinus radiata
atcctctgctacattataggtaaatgcgtggctattgtattcaccacatgaagtacatac

SEQ ID NO: 3439 - DNA, 60 bp, Pinus radiata
aacagtttcagttatcgatggggctaacacatctcccactacacctaatacatctccagc

SEQ ID NO: 3440 - DNA, 60 bp, Pinus radiata
tctgtattagtaagagccctttttcttggggtatattttctttctagtcatgtatcctat

SEQ ID NO: 3441 - DNA, 60 bp, Pinus radiata
acactgaccttagtgcattgcttagactgaattaaaatctggtaaagtgtgaataggata

SEQ ID NO: 3442 - DNA, 60 bp, Pinus radiata
ttattagatagaaacctatagatggcaatcgtcatctgtatgggcactttcatgtagaga

SEQ ID NO: 3443 - DNA, 60 bp, Pinus radiata
cttaatactggcagttttattatgcctcctaaaactcagcagcatataaatgagctattg

SEQ ID NO: 3444 - DNA, 60 bp, Pinus radiata
acgctggaattctatacagtatgcatcagctttcggtgcaatggcgttagtaggactggg

SEQ ID NO: 3445 - DNA, 60 bp, Pinus radiata; identical to SEQ ID NO: 3439

SEQ ID NO: 3446 - DNA, 60 bp, Pinus radiata
cattgattcctcaaagcaatttgtcacctgtaaaattatgaaccagtagtttacgttgct

SEQ ID NO: 3447 - DNA, 60 bp, Pinus radiata
ttttgtggctgaaatatcatggctaatttagtttatcgtatcatgcctgttcaaatgctg

SEQ ID NO: 3448 - DNA, 60 bp, Pinus radiata
ctcgatcatttcctgccaaaagaattgagacggggcaaagcggggataagagtgtccatg

SEQ ID NO: 3449 - DNA, 60 bp, Pinus radiata
acgccgaagacgattatgaaagtaatgggtgtcaaggggcttactctctaccacctcaag

SEQ ID NO: 3450 - DNA, 60 bp, Pinus radiata
gagattatacgcaccttacatggtccaaccttttatcaaggcagtcattgaggaatgcat

SEQ ID NO: 3451 - DNA, 60 bp, Pinus radiata
atcatggtactactctctttaactagttgtcacgcttaagtacttgaggcgtgtttctaa

SEQ ID NO: 3452 - DNA, 60 bp, Pinus radiata
tttggtcaacttaggcccttaccttactatgtctgaacaatagaggtatgtactctttat

SEQ ID NO: 3453 - DNA, 60 bp, Pinus radiata
gctgttactgctatactctttatttagtaatgtgattagaagctcgtctgcttcttcgct

SEQ ID NO: 3454 - DNA, 60 bp, Pinus radiata
atcatgtattaactatgtaagttttcagagtcgttgactcatgctacggcttctaacatt

SEQ ID NO: 3455 - DNA, 60 bp, Pinus radiata
ttttcgaagtgtagggtaaatttagtgccaacatgaatgcatagaaaacactatacagca

SEQ ID NO: 3456 - DNA, 60 bp, Pinus radiata
aagaaaagtgctcttcagaacgtgtcaaaccttattcctccccctgtaactaattcattg

SEQ ID NO: 3457 - DNA, 60 bp, Pinus radiata
ttcaaacaagagcaccgggttgtaaacatgtgtaatatttctggttaaagataaaatcct

SEQ ID NO: 3458 - DNA, 60 bp, Pinus radiata
tgcaggccttgtgcttacagtattgtctgaaagttattgtattacttatgtaggatcctt

SEQ ID NO: 3459 - DNA, 60 bp, Pinus radiata
tttgtataaaccaggtgtagcattgtaatagaaaaaacattaacaagcaacgacgttgga

SEQ ID NO: 3460 - DNA, 60 bp, Pinus radiata
ccatgcaagggtactggttcgggtattgactccccgcaaaatcttaatcgtttgctactc

SEQ ID NO: 3461 - DNA, 60 bp, Pinus radiata
tggtgtaattgtactatgtacgtattttgttatatgccaatgcccatatacatgtagcca

SEQ ID NO: 3462 - DNA, 60 bp, Pinus radiata
tgcagaacgaatgacgttgtttggttaaaggattctctgatagcccaagttttataatgg

SEQ ID NO: 3463 - DNA, 60 bp, Pinus radiata
gccatcattcttttctgaaagatgtggtgcatgccattcttttacattttcagatggttt

SEQ ID NO: 3464 - DNA, 60 bp, Pinus radiata
tgtatccttgaatgggtttggaccaatctatttgtcataaacctaatatttaaggatttc

SEQ ID NO: 3465 - DNA, 60 bp, Pinus radiata
cagtaaatgcattatgcaaatgtgctctgtaatgcaaccctaataatacttactatcatt

SEQ ID NO: 3466 - DNA, 60 bp, Pinus radiata
aagagcgtccaatagctcgcccatgccgatggaatatggtaaatcatctttattattccc

SEQ ID NO: 3467 - DNA, 60 bp, Pinus radiata
gagtaacctctcatatatccatgacatgttgacgcaatgagcaataagtgcttgattaga

SEQ ID NO: 3468 - DNA, 60 bp, Pinus radiata
aatttttcggttgtaaaggttaggttccttgtggaactgtagatctatgtggatgctgag

SEQ ID NO: 3469 - DNA, 60 bp, Pinus radiata
ctgttattggtattttttaactgttatatgtataactgccctttgatttggtactattca

SEQ ID NO: 3470 - DNA, 60 bp, Pinus radiata; identical to SEQ ID NO: 1922

SEQ ID NO: 3471 - DNA, 60 bp, Pinus radiata
aatcgggtgatcaaagacgtgtcattactttgccctcgaaaatgctagggaaggtagcag

SEQ ID NO: 3472 - DNA, 60 bp, Pinus radiata
aacaagcgtaaatacaggtggatcaaggttgaaagctgacctccctttgcgggagggaat

SEQ ID NO: 3473 - DNA, 60 bp, Pinus radiata
tctctttcgatcctgaattaccgggtagcatgcagtacatatctggaatgtcctctcaat

SEQ ID NO: 3474 - DNA, 60 bp, Pinus radiata
aaatcggtatgtagagaatcgggggacatgatttattcatgcgccagaatttcacgattc

SEQ ID NO: 3475 - DNA, 60 bp, Pinus radiata; identical to SEQ ID NO: 3114

SEQ ID NO: 3476 - DNA, 60 bp, Pinus radiata
ttatggtgttctagtgttttactcatgtggtgcaagtagtctgagttaggttttcaccag

SEQ ID NO: 3477 - DNA, 60 bp, Pinus radiata
aagcgagggactgaatctaacttgtacatgtaagtgtgctctttatgttcccttatggtg

SEQ ID NO: 3478 - DNA, 60 bp, Pinus radiata
caaatattgttccgagtaatcgtaatggtgttacggctaaatttgttacgtttgagatct

SEQ ID NO: 3479 - DNA, 60 bp, Pinus radiata
gcagaatgaacaacctacatagaaggtagaatgtcacgcgagaccttatcgtttcccaaa

SEQ ID NO: 3480 - DNA, 60 bp, Pinus radiata
gacctattatgaagagtagaatgtccatgaataatgcgtatttgtagactagcccgtaca

SEQ ID NO: 3481 - DNA, 60 bp, Pinus radiata; identical to SEQ ID NO: 3081

SEQ ID NO: 3482 - DNA, 60 bp, Pinus radiata; identical to SEQ ID NO: 3105

SEQ ID NO: 3483 - DNA, 60 bp, Pinus radiata
caactcaaaacataactgtgatggcttaaggaccataattcattctatcaggcgaaatca

SEQ ID NO: 3484 - DNA, 60 bp, Pinus radiata
aaatactggaggcctaataatttgcatcaacctatcctacaatattgctagtctctttat

SEQ ID NO: 3485 - DNA, 60 bp, Pinus radiata
aatggcattagctgtgatgtcctctgttatgaacacttacttgccccaataattctgaag

SEQ ID NO: 3486 - DNA, 60 bp, Pinus radiata
gctttcctcgcgtccctttgaaattgacttaggagttttttaatccggagtctaattatc

SEQ ID NO: 3487 - DNA, 60 bp, Pinus radiata
agaaaatatcccgcataagtattttagaggggagagtcccactcaattttcaagttacat

SEQ ID NO: 3488 - DNA, 60 bp, Pinus radiata
cttgttcactcgtcaattaccaggtagtctgcagtacatatctaaaacgtcctgtcaatc

SEQ ID NO: 3489 - DNA, 60 bp, Pinus radiata
tcagaatcttgaactctggttgattgaggcttttgctgcttattgtgagtggatttttgt

SEQ ID NO: 3490 - DNA, 60 bp, Pinus radiata; identical to SEQ ID NO: 3142

SEQ ID NO: 3491 - DNA, 60 bp, Pinus radiata; identical to SEQ ID NO: 3144

SEQ ID NO: 3492 - DNA, 60 bp, Pinus radiata
agtaccagatagttcaggagcttcatctaaagtggttcatccagagaaaattttaccagc

SEQ ID NO: 3493 - DNA, 60 bp, Pinus radiata
agtcgagtctaagttacaggtcgtcatacaagaaaagtagaaattagtagttagcgtgta

SEQ ID NO: 3494 - DNA, 60 bp, Pinus radiata
tttccacaaagaggatacagtaataacttcctcacatgttatgaaagcagacagttgttt

SEQ ID NO: 3495 - DNA, 60 bp, Pinus radiata
ttccattgagttcatgaacttagaagaaggcttattggcctctaatcaaattacttttat

SEQ ID NO: 3496 - DNA, 60 bp, Pinus radiata
atatttacacgtgagtatgtaaaacgaattcgtgtctaggcattggctggtctacgatat

SEQ ID NO: 3497 - DNA, 60 bp, Pinus radiata
tgcctcgggaaactcccgctgtaatctagatgtgtttttccatgtacataatgaaccata

SEQ ID NO: 3498 - DNA, 60 bp, Pinus radiata; identical to SEQ ID NO: 2906

SEQ ID NO: 3499 - DNA, 60 bp, Pinus radiata
aatagagagattattatggaattgcatatcctttcggggttctactatgttaagagctca

SEQ ID NO: 3500 - DNA, 60 bp, Pinus radiata
atgaggtgccgtgaaccatcacttttggacttacagcacatgcagctttagtggggttta

SEQ ID NO: 3501 - DNA, 60 bp, Pinus radiata
gcagcatgcttgactcttaagctcggtggaagtgattatcctgttacagagacagatgca

SEQ ID NO: 3502 - DNA, 60 bp, Pinus radiata
gcttgaggtagtgttatttgttggtccaaaggaccacttgggtacagattgtataggaat

SEQ ID NO: 3503 - DNA, 60 bp, Pinus radiata
gaggcaagcagtatatatgatgtggatcaatattagcgacagctagcatgaattttaatg

SEQ ID NO: 3504 - DNA, 60 bp, Pinus radiata
gaagcgttattaacggatttttaaagcagcattggtcagtattttctataatataaactt

SEQ ID NO: 3505 - DNA, 60 bp, Pinus radiata; identical to SEQ ID NO: 3164

SEQ ID NO: 3506 - DNA, 60 bp, Pinus radiata
atcaaaaaggccaggccaggccaggctatttaaagactagttggtagttaagctactgct

SEQ ID NO: 3507 - DNA, 60 bp, Pinus radiata
aaaatcttattctattagtaaagtagccattaaaggcaatcggaagcaggaagcaggtta

SEQ ID NO: 3508 - DNA, 60 bp, Pinus radiata
tcacaattattaacattggtaaatacttccactggctaggcttttttctttcccctttac

SEQ ID NO: 3509 - DNA, 60 bp, Pinus radiata
atattgtaactgtatcgatagagaggagcaggggaggggggacgagagggattgaataat

SEQ ID NO: 3510 - DNA, 60 bp, Pinus radiata
ttcagatatgcctgtttgtatttgtcgatgcaggaaattgattggttatttttattgcca

SEQ ID NO: 3511 - DNA, 60 bp, Pinus radiata
gtattagaagtaaactggaaagtcatccttaggtggcttgtttccatttttagggacaat

SEQ ID NO: 3512 - DNA, 60 bp, Pinus radiata
atttggtcctaaaatcctaatatctacgcattatgtcacaaagtttaagtgcttggaaca

SEQ ID NO: 3513 - DNA, 60 bp, Pinus radiata
atgggtatgtgtagcattttggaatcagtttcataggaaaacaacatgttaatgcaatat

SEQ ID NO: 3514 - DNA, 60 bp, Pinus radiata
ctcagaaatatgttataggttgtggtactgttaactatttcgcaggtcctgtattaagaa

SEQ ID NO: 3515 - DNA, 60 bp, Pinus radiata
tctaaacatatatacatagttatatatacatacttatcctgtttcgaagaacatcaccat

SEQ ID NO: 3516 - DNA, 60 bp, Pinus radiata
cttaactggcattcatgaatttcaagttatatatacaagtagctctgatggttaatcagg

SEQ ID NO: 3517 - DNA, 60 bp, Pinus radiata
atattctagtattggttcaggtaattctggtcacatatattacaaccagcctaatgagag

SEQ ID NO: 3518 - DNA, 60 bp, Pinus radiata
aatttagatctctggaatgcagtgactattgtaaatgctcattttcgggctaaattatct

SEQ ID NO: 3519 - DNA, 60 bp, Pinus radiata
tcagttgtgtacaggcaacttgagtaggttttctttgtatagcttccttatcatacagat

SEQ ID NO: 3520 - DNA, 60 bp, Pinus radiata
agaaaagccagagtttcagtccgggccagatccgaggctcccatggtaattaattgctca

SEQ ID NO: 3521 - DNA, 60 bp, Eucalyptus sp.
cgatgatgattaacctcctacttgttgcctcttttttgcaactgagaaaagcgaaaagac

SEQ ID NO: 3522 - DNA, 60 bp, Eucalyptus sp.; identical to SEQ ID NO: 3194

SEQ ID NO: 3523 - DNA, 60 bp, Eucalyptus sp.; identical to SEQ ID NO: 3335

SEQ ID NO: 3524 - DNA, 60 bp, Eucalyptus sp.
atctagtaatcacgtggcaggaaggtcgcaagtgcatggaactcacagaggtcatgacta

SEQ ID NO: 3525 - DNA, 60 bp, Eucalyptus sp.; identical to SEQ ID NO: 2507

SEQ ID NO: 3526 - DNA, 60 bp, Eucalyptus sp.
agtgtatgaattgagcaagtcttagattacgtgtgtttgctgtcattactcaatagtcat

SEQ ID NO: 3527 - DNA, 60 bp, Eucalyptus sp.
tcctggccgttctgttttatgtaaataagtgtgatacaggtcatgctctatactaccaat

SEQ ID NO: 3528 - DNA, 60 bp, Eucalyptus sp.
tgaaggcttgggagttactgaagggaagacctcacagcatcgatctcatattgaccgaag

SEQ ID NO: 3529 - DNA, 60 bp, Eucalyptus sp.
gagtaagcgagggcatatattcccctaccccaacattgccccactcgtgtttccagatat

SEQ ID NO: 3530 - DNA, 60 bp, Eucalyptus sp.
aaattaatactgaattagttgcttaagatgcacacatcgaaattcattttgtttacttgc

SEQ ID NO: 3531 - DNA, 60 bp, Eucalyptus sp.
caccccaaaaccagtctaaataagattctgtggcttttgttatattaccacataattaaa

SEQ ID NO: 3532 - DNA, 60 bp, Eucalyptus sp.
aggaagagaaaccaattacaggggtattggatgggagaggggaatatactcttgtttatg

SEQ ID NO: 3533 - DNA, 60 bp, Eucalyptus sp.
gggaccagtacctgatatcctgttcgttggataagaaaattaaggtctggggggttgcca

SEQ ID NO: 3534 - DNA, 60 bp, Eucalyptus sp.
gtgtcaagattctccagagtccactgttgtagagtacaagccagagtctacgaaagaaga

SEQ ID NO: 3535 - DNA, 60 bp, Eucalyptus sp.
gagaggtcaatccacttagtgagtccatgtcctggcctaaatcttgagtatcccctgttt

SEQ ID NO: 3536 - DNA, 60 bp, Eucalyptus sp.
aggacaaataacaggatggattccccaagtactaatagtattacagccataccacgaaga

SEQ ID NO: 3537 - DNA, 60 bp, Pinus radiata
tttggacgagatttgagcaattccgacagaaatacaagctacgacagtaccccatcaatg

SEQ ID NO: 3538 - DNA, 60 bp, Pinus radiata
attttaggtattccccaagtcgaaaatggtaaagtcatgctcgtgccgaattcggcacga

SEQ ID NO: 3539 - DNA, 60 bp, Pinus radiata
tgggaaaattgaatgtttcttatgatgacctatttatgccttcatgaacaacagccaatg

SEQ ID NO: 3540 - DNA, 60 bp, Pinus radiata
gtcgaatttgttgtattaaaggtagagcttgagtccatgttgtcatttcggcgctcgcat

SEQ ID NO: 3541 - DNA, 60 bp, Pinus radiata
gaatgcccattgtcgtagtttgcctttattaatcgccaaacgttttagcatgtacattgg

SEQ ID NO: 3542 - DNA, 60 bp, Pinus radiata
agcttaatcagtgtcataggtagtatgtaaaccatggtggtaaactatccatattagcat

SEQ ID NO: 3543 - DNA, 60 bp, Pinus radiata
tctaataatttactccattacatgtaattcttatgctaatgcttattttttaagtaaata

SEQ ID NO: 3544 - DNA, 60 bp, Pinus radiata
gtgcaggtggttaagagatcttttacgagggtcgtagttcgaggtctcattgacctttct

SEQ ID NO: 3545 - DNA, 60 bp, Pinus radiata
tttatctgaaaccgccaagatttacgagtttgcaagcaacaagtcgtgactagctcttgt

SEQ ID NO: 3546 - DNA, 60 bp, Pinus radiata
aaattcggatgccgaaatcccatgagaagatatggctgggatcctataataccgccgagc

SEQ ID NO: 3547 - DNA, 60 bp, Pinus radiata
attccaacgtgaatcaatctcgcagagaaatgcaccctcttgtcgacgtaccttcgcatc

SEQ ID NO: 3548 - DNA, 60 bp, Pinus radiata
gtaacatgttacctcatagcacagtgtattgtgatgaggacgttacatatttaccatcac

SEQ ID NO: 3549 - DNA, 60 bp, Eucalyptus sp.; identical to SEQ ID NO: 2506

SEQ ID NO: 3550 - DNA, 60 bp, Eucalyptus sp.; identical to SEQ ID NO: 2643

SEQ ID NO: 3551 - DNA, 60 bp, Eucalyptus sp.; identical to SEQ ID NO: 2642

SEQ ID NO: 3552 - DNA, 60 bp, Pinus radiata
tgtaaatccaagccctcagttcaagggcacgagacgcatgaaaaactcttttaatatata

SEQ ID NO: 3553 - DNA, 60 bp, Eucalyptus sp.; identical to SEQ ID NO: 2640

SEQ ID NO: 3554 - DNA, 60 bp, Eucalyptus sp.; identical to SEQ ID NO: 2643

SEQ ID NO: 3555 - DNA, 60 bp, Eucalyptus sp.; identical to SEQ ID NO: 2642

SEQ ID NO: 3556 - DNA, 60 bp, Eucalyptus sp.; identical to SEQ ID NO: 2640

SEQ ID NO: 3557 - DNA, 60 bp, Eucalyptus sp.; identical to SEQ ID NO: 2643

SEQ ID NO: 3558 - DNA, 60 bp, Eucalyptus sp.; identical to SEQ ID NO: 2642

SEQ ID NO: 3559 - DNA, 60 bp, Eucalyptus sp.; identical to SEQ ID NO: 2643

SEQ ID NO: 3560 - DNA, 60 bp, Eucalyptus sp.; identical to SEQ ID NO: 2373

SEQ ID NO: 3561 - DNA, 60 bp, Eucalyptus sp.; identical to SEQ ID NO: 2674

SEQ ID NO: 3562 - DNA, 60 bp, Eucalyptus sp.; identical to SEQ ID NO: 2696

SEQ ID NO: 3563 - DNA, 60 bp, Eucalyptus sp.; identical to SEQ ID NO: 3304

SEQ ID NO: 3564 - DNA, 60 bp, Eucalyptus sp.; identical to SEQ ID NO: 2726

SEQ ID NO: 3565 - DNA, 60 bp, Eucalyptus sp.; identical to SEQ ID NO: 3308

SEQ ID NO: 3566 - DNA, 60 bp, Pinus radiata
aataagctagaaatgctaagaattttgtgaatcgctaaagcatttgtaacatatagcgca

SEQ ID NO: 3567 - DNA, 60 bp, Eucalyptus sp.; identical to SEQ ID NO: 2732

SEQ ID NO: 3568 - DNA, 60 bp, Eucalyptus sp.; identical to SEQ ID NO: 3307

SEQ ID NO: 3569 - DNA, 60 bp, Pinus radiata; identical to SEQ ID NO: 3114

SEQ ID NO: 3570 - DNA, 60 bp, Eucalyptus sp.; identical to SEQ ID NO: 2782

SEQ ID NO: 3571 - DNA, 60 bp, Pinus radiata; identical to SEQ ID NO: 3022

SEQ ID NO: 3572 - DNA, 60 bp, Eucalyptus sp.; identical to SEQ ID NO: 2724

SEQ ID NO: 3573 - DNA, 60 bp, Eucalyptus sp.; identical to SEQ ID NO: 2762

SEQ ID NO: 3574 - DNA, 60 bp, Eucalyptus sp.; identical to SEQ ID NO: 2788

SEQ ID NO: 3575 - DNA, 60 bp, Eucalyptus sp.; identical to SEQ ID NO: 2787

SEQ ID NO: 3576 - DNA, 60 bp, Eucalyptus sp.; identical to SEQ ID NO: 2787

SEQ ID NO: 3577 - DNA, 60 bp, Eucalyptus sp.; identical to SEQ ID NO: 3334

SEQ ID NO: 3578 - DNA, 60 bp, Eucalyptus sp.; identical to SEQ ID NO: 2805

SEQ ID NO: 3579 - DNA, 60 bp, Eucalyptus sp.
gaaaggtcggatgcatgaaggtgacaagcacgacttctagactaacagcccaacttgttt

SEQ ID NO: 3580 - DNA, 60 bp, Pinus radiata
ctgctaccggacattgtattcctgtgactctcttccaatgtgtagtctgggataatgagt

SEQ ID NO: 3581 - DNA, 60 bp, Pinus radiata
gtcccttgtgtagggtaaataatgttagtatgctaatgaaccggcgaagttgacgttaca

SEQ ID NO: 3582 - DNA, 60 bp, Pinus radiata
tgtaatttgcggtttgtatggattagagcgtagtgtaattcgccggttatcaggtaaaca

SEQ ID NO: 3583 - DNA, 60 bp, Eucalyptus sp.; identical to SEQ ID NO: 2778

SEQ ID NO: 3584 - DNA, 60 bp, Eucalyptus sp.; identical to SEQ ID NO: 2771

SEQ ID NO: 3585 - DNA, 60 bp, Pinus radiata; identical to SEQ ID NO: 3111

SEQ ID NO: 3586 - DNA, 60 bp, Pinus radiata; identical to SEQ ID NO: 2412

SEQ ID NO: 3587 - DNA, 60 bp, Pinus radiata
atgatttgcgtacagctattataagattgttaacaaactttctaatatagtattagactt

SEQ ID NO: 3588 - DNA, 1542 bp, Eucalyptus sp.
aaatcaagccccctgccccctgaccccctgccccccctttttggctcctccaacttctccttcaatgatttctctccacatcactcaagacaactcactcccatcatcccccctttctctttctgcgcaaccaagagcaacccttcaagtggagggctgggatggctttctgttagcagcaaacagctgaggacaaaaaaagaattcaatcttgcaaaaggagagaagctcggtcgtcctgggtgaggaaaggtctctgagtcgctttgcctacaatctcatttaattgaagtggtggaaggcttaatggattggaatctgaaagctccttgggatttgactgaatttggccaagaaaccctgccaggcagccatggagctgatgggccgaatagctatgggattcctagtgcaaaaggagaattttcggttgatttgaagctgggtcaaatgagtaacacagtgaacgaaccggtaaatatgtggaaggactctggtgtctcaaagatggcatcgtctccatcggggtcgtcgaagagggctcgatcggcgagcagtgggggtcaggcagtacattgccttgttgacggttgcaatgcggaccttagtaactgtagagagtaccataggcgccacaaggtctgcgaagttcactccaagactcccgaggtgacgattaatggtagaaaacaaaggttttgtcagcaatgcagcaggttccattcactggaggaatttgatgagggcaaaaggagttgcaggaagcgccttgatggacataacagaaggcgaagaaaacctcagccggatccactaagtcggtcagcagacatcttttccagttttcgaggtccccaattagtaccgctatctaactcacaggtatatcccactactgctgttggcaacccaacatgggccggagttgtcaatcctgaacaggaggctgctctatatgcccgccaccaacacctatatgggtcatcctctagcatatatgggggaggcaaacaaattaaattcttgcaagggaataatcccgtgttgagcagccaaatgtctgccgaatcttctgtatgtcagcagctccctaggacaattgtttcgtctgatagtggtgggcttggccgcaatatgttctatgaccggctagtcagcgaatcggactgtgctctctctcttctgtcatcaccacagatgcagacttcaggaactaatttcagccatctggcgcaccaaaactcccaccgcggtaatcacagctcagagcccttggactctgttcgcatttccagtggcagcggaaggaataccaattcccagggattgttccacttaggatctgaaggacggcaaaggaatgaagcctctcaagtaattccctttcactgggactagtaagctataagctcactcccgaatttcctgatgcataattactgcatattcattctcatgtagagattatcgtggtattctttctcgtatgtaaactgtgttttggtgaactgttctaattcagagtattaactaaaaaaaaaa

SEQ ID NO: 3589 - DNA, 2223 bp, Pinus radiata
gcgttagcaggcaggggagtggccgacggcggtctgtgcagatggcggctggccaggtggtggtgatcctgtcggcttgtcgcgcttcccacccgcatcgactcgtctctttaccgacttgactccgatattagatggccatgactcctgcccatacatggctccaacaatagtaaagtcagtctgcttggttggccttgtggtctatatggtctaacactttagtttttcacaattagtcctggtctggttcgcaattcatttttcttcatgtgctgtaagtgaatttcagtttggatccagctctggccaagagatttccattgggtattttctgttacagagctttaattaccctgggattgattgtggatgaaaatggaggtctccatggacaagtctttggggagtagtagtatgtcagaagagtcccaagagatgacctgcaaaaatgcagaaaaatctctgcagcttcatgattatattggtctctctgaggtctcttctcattcaatgacgaatcctcccctgccaatgccctgcgaccctaattctcacttgggggaggcagagctgaggttgggtttaagcctagcagcatcagaatgggcactgggagataacagcggtccagagccaaatttcgcaggagcgttgcaaaatcaagcacaggctatggatgatggtactaaatgtgggtatgggttggccatggctactggaagcaagaggggcttcaatcaagcgtttgggaacaggagtgagaaacaggtgggcaaggggctccttaagctccaaatgtatgaaccctctcacccatctggaatggcagcacagcagtacagtagtaagcctcctcaaccttcttctctgccagatgaacaatcaggagtggcagattcttcttctaccagtccaaagagtccagttgtgggttggccaccaattcgatcgtataggaaaaacactttggctgctcaaccaatgtcctttgaagacggggatgaagaggagcaatgggagggtgttgtagaaacaccagctagttctgtgcagagtcagggcaattcaatttcactgtttgtgaaagtaaacatggagggcgtaccaattggtagaaagatagatctcaacacccacaatggttataaatctctagctttagcattggaggatatgttccatcgcccccctaactttcaagaaaatggttttttcggtccatcaaaaaagtcatggcttgtggaggattgttctgattatctgttgacttacgaagacaaagaaagggattggatgcttgtaggtgatgtcccatggggaatgtttgtaagcaccgtcaaacgtctaaggattgtgaaaacctcagaaggcaatggccttggtgaaggcaatggccttggtccaaattgctccgaaaagatgaattgcagaaagacaaaagctgcctgaattctggatattgcttcacagtctcctaattcattccagtgaatggaaaaatctgtcgaatcctaatatatatacgcacatatatagctagcatttgaattttactggttagtgcactaaaataaaaaggtgcgatatctcaggcaatttcattatctgatctgagtactgcctttacttccataaagtaactctgtcatatatacatatatagttctaagtgtaccaagctagctttctactctgtcatatatacatatatatatatagttctaagtgtaccaagctagctttctatgttaatgcggatatgatcaatactcaatactcgttttgggttttaagttggatatgaacaattattcaatgagggaattaatacctaggagtctggggattcttgcttggagagcggtttcagtcttggatttcagccccatgtgcctctgtacgcagatagtgctacctatctgagttgcaggaaaggtaaacctgctacagctttgagggttatggttaaacaggagacctaacctgtttatgtaaaaggctcaaagggttacaatagaatggatcaccttgattttttttgttaggatataaataaataatgtcttctttgccctgggttttttcaagaattgtattccgggatgataatcttgccaaatgtgtaatcatagtgaagaggaattaattataccacaaataattgtacagttctgtactctatacatttattagcagagattcttttgtataaaaaaaaaa

SEQ ID NO: 3590 - DNA, 2116 bp, Pinus radiata; identical to SEQ ID NO: 767

SEQ ID NO: 3591 - DNA, 2984 bp, Pinus radiata; identical to SEQ ID NO: 1835

SEQ ID NO: 3592 - DNA, 1939 bp, Eucalyptus sp.; identical to SEQ ID NO: 1890

SEQ ID NO: 3593 - protein, 363 aa, Eucalyptus sp.
MDWNLKAPWDLTEFGQETLPGSHGADGPNSYGIPSAKGEFSVDLKLGQMSNTVNEPVNMWKDSGVSKMASSPSGSSKRARSASSGGQAVHCLVDGCNADLSNCREYHRRHKVCEVHSKTPEVTINGRKQRFCQQCSRFHSLEEFDEGKRSCRKRLDGHNRRRRKPQPDPLSRSADIFSSFRGPQLVPLSNSQVYPTTAVGNPTWAGVVNPEQEAALYARHQHLYGSSSSIYGGGKQIKFLQGNNPVLSSQMSAESSVCQQLPRTIVSSDSGGLGRNMFYDRLVSESDCALSLLSSPQMQTSGTNFSHLAHQNSHRGNHSSEPLDSVRISSGSGRNTNSQGLFHLGSEGRQRNEASQVIPFHWD

SEQ ID NO: 3594 - protein, 359 aa, Eucalyptus sp.
MKMEVSMDKSLGSSSMSEESQEMTCKNAEKSLQLHDYIGLSEVSSHSMTNPPLPMPCDPNSHLGEAELRLGLSLAASEWALGDNSGPEPNFAGALQNQAQAMDDGTKCGYGLAMATGSKRGFNQAFGNRSEKQVGKGLLKLQMYEPSHPSGMAAQQYSSKPPQPSSLPDEQSGVADSSSTSPKSPVVGWPPIRSYRKNTLAAQPMSFEDGDEEEQWEGVVETPASSVQSQGNSISLFVKVNMEGVPIGRKIDLNTHNGYKSLALALEDMFHRPPNFQENGFFGPSKKSWLVEDCSDYLLTYEDKERDWMLVGDVPWGMFVSTVKRLRIVKTSEGNGLGEGNGLGPNCSEKMNCRKTKAA

SEQ ID NO: 3595 - protein, 448 aa, Eucalyptus sp.; identical to SEQ ID NO: 1587

SEQ ID NO: 3596 - protein, 459 aa, Eucalyptus sp.; identical to SEQ ID NO: 1327

SEQ ID NO: 3597 - protein, 549 aa, Eucalyptus sp.; identical to SEQ ID NO: 2228

SEQ ID NO: 3598 - protein, 253 aa, Eucalyptus sp.; identical to SEQ ID NO: 825

SEQ ID NO: 3599 - protein, 242 aa, Eucalyptus sp.
MGGGAWPFLVGGAICLVNSDNDIAAAAADGGPFQVSGSGFSWPDQPLNGSSIFSAEIDGSLGDSDGVKENGSKKRVRSESCSASSSKACREKLRRDRLNDKFLELASILEPGRPPKTDKAAILIDVVRMVTQLRGEAQKLKDSNSSLQEKIKELKAEKNELRDEKQRLKAEKEKLEHQLKAMNAQPSFLPPPPAIPAAFATQGQAPGNKLVPFIGPGVAMWQFMPPATVDTSQDHVLRPPVA

SEQ ID NO: 3600 - protein, 409 aa, Eucalyptus sp.
MGNNEETKSSKSDKSSSPVPPQDQTGVHVYHPDWAAMHAYYGPRVALPPYYNSAVSSGHGPHPYMWGPPQPMMPPYGPPYAAIYSHGGVYGHPAIPLTPTPLAAETPKKSSANSDNGLVKKLKSFEGLAMSIGSGGDADSADDGTDKRSSQRFVSSADSGDSSDEDQSGADKARRKRSREGTSSNGDGKSEVQGKAAGEVDAASENVSGGAIERPRATGKLAAPVNSPSMSSSLDLKNSCMDANANPVSILQPGVVPPEAWLNERELKRERRKQSNRESARRSRLRKQAETEELAKKVDSLSAENRALKSEISQLTENSDKLRLENATLMERLENAQGVEKGVESLGKFNDNGLLSDKTENLLSRVNNSGAVDRRSEDEGEIYERKSNSGAKLHQLLDSKPRTDAVAAG

SEQ ID NO: 3601 - protein, 238 aa, Eucalyptus sp.; identical to SEQ ID NO: 947

SEQ ID NO: 3602 - protein, 175 aa, Eucalyptus sp.
MVKRDREDTEVEALARANCLMLLSRVGESTDSASPDRKSRPTERMFACKTCNREFSSFQALGGHKASHKKPKLISGDLFHLGHAADSSPAKPKTHECSICGLDFPMGQALGGHMRRHRAAMLESLAAAAAKPVPVLKKSNSKRVTGLDLNSLPMEDDLTLRLGKVAPPLVLDLVL

SEQ ID NO: 3603 - protein, 663 aa, Eucalyptus sp.
MEGESYFEKDEKHSNCSILLELSASDDLPAFESKAKAKGCNIDGASFWYGRRIGSRKMGLEERTPLMVASLFGSSRVVKYILESGKVDVNRACGSDKVTALHCAVASGSASAVEVVKLLLHASADANCIDGNGKKPIDVIALPLKSRGDSRRKLMELLLKGDNSDGEFESHEEKPIAAPQASKEGSEKKEYQFPVDISLPDINVGIYSTDEFRMYAFKVKPCSRAYSHDWTECPFVHPGENARRRDPRKYPYSCVPCPEFRKGSCQKGDSCEYAHGVFESWLHPAQYRTRLCKDETGCARKVCFFAHKPEELRPVYASTGSAMPSPKSYSSSGLDMSTLSPLSISSPSASLPVTSTAPMSPLAASSSPMSVNMWQSKANKLSPPMLQLSGSRLKTALSARDLDLEMELRGLESQMATQQHQLMEEISRLSSPSSCFSSRIGEVKPTNLDDVFGSPDPALLPQLQGLSRPSTPSQLQSPTGLQMRQNATQFRGAYQSNANALSSPAMKQAPSYGFDSSSAVAAAVMNSRSAAFAKRSQSFIDRGMASPGIANSSPMMSSAMSSWSSPHGKLDWGVQGDELNRLRKAASFKMRSSTGAGANTVSAAAMADEPDISWVSSLVKDVPSAEDAMFAAEKGQRTYGKDIRERITPWVEQLYREVPRMAM

SEQ ID NO: 3604 - protein, 264 aa, Eucalyptus sp.; identical to SEQ ID NO: 1054

SEQ ID NO: 3605 - protein, 315 aa, Eucalyptus sp.
MAGGASASASAITTLLQNQRVPPPPPSDAFFLSGSSPFLGSRAMVSFEDAHRGNRLNRPFFRSIDPDENGEDDLEDYFHQPEKKRRLTVEQVQFLEKSFEVENKLEPDRKIQLAKDLGLQPRQVAIWFQNRRARWKTKQLEKDYETLQASFNTLKSDYDTLIKERNDLKAEVLNLTDKLLHKGNEKESSESSSKSSQGLFQNPIADSVSEDEVSRVPIPTWPEDICSVKSDMFDSESPHYTDAAHSSLLEPGDSSYAFEPDHSDLSQDEEDNLSKSLLSTRNYPKLENSDYAILPPNSCNFGFHAEDPAFWPWSY

SEQ ID NO: 3606 - protein, 837 aa, Eucalyptus sp.
MMAVTSACKDKMGIDNGKYVRYTPEQVEALERLYHECPKPSSLRRQQLIRECPILSNIEPKQIKVWFQNRRCREKQRKEASRLQAVNRKLTAMNKLLMEENDRLQKQVSQLVYENSYFRQQTQNATLATTDTSCESVVTSGQHHLTPQHPPRDASPAGLLSIAEETLTEFLSKATGTAVEWVQLPGMKPGPDSIGIIAISHGCTGVAARACGLVGLEPSRVAEILKDRPSWYRDCRAVDVANVLSSGNGGTVELLYMQLYAPTTLAPARDFWLLRYTSVMEDGSLVVCERSINNTQNGPSMPPVQHFVRAEMLPSGYLIRPCEGGGSIIHIVDHMDLEPWSVPEVLRPLYESSTLLAQRTTMAALRNLRQISQEVSQPNVTGWGRRPAALRALGQRLSKGFNEAVNGFMDDGWSMLESDGVDDVTLLINSSPAKMAGVNISYASGFPSMTSAVLCAKASMLLQNVPPAILLRFLREHRSEWADSSIDAYSAAAIKASPCNMPGTRIGGFGSQVILPLAHTIEHEEFMEVVKLENMGHYRDDMIMPSDIFLLQLCNGVDENAVGTCAELIFAPIDASFSDDAPIIPSGFRIIPLDPGSDASSPNRTLDLASALDVGPTGNKAVGDNSGHSGNTKSVMTIAFQFAFELHLQENVASMARQYLRSIIASVQRVALALSPTNLGCHASLRPPPGSPEAHTLARWICQSYRSFLGVALLKNEAADSLLKNLWHHSDAILCCSLRAAPVFTFANQAGLDMLETTLIALQDITLEKIFDDNGRKTLCSEFPQIMQQGFMCLQGGICLSSMGRPISYERAVAWKVLNEEETAHCICFMFVNWSFV

SEQ ID NO: 3607 - protein, 962 aa, Eucalyptus sp.
MKADDALPDHLRCNRTDGRQWRCNRPVMEDKKLCEIHYLQGKHRQHKEKVPESLKIQRRTGKSEGKVPALHNLKIRAQKIEKPGRRAVRMRRKNLARELVRIVVKREAEKRREVEGSGGEDMMRRLPNGVMVISQSAARRQQQQSGGANDNVGSQCDVKVGVDANVAPRRRFRSKNLEPLPIGAVQVMPYKRNVEKVGRKKCHWCKSSGATSLIKCSSCRKHHFCLECIEGRYFDTQEEVKMECPVCRKTCRCKACLAYKYKDSACQELSSDHSRADKILHSHHLISVLLPVLKEINEERSIELEVEAKVKGTEVSQLQVHQAECGFNKQYCCNNCRTSILDLHRSCSSCSYNLCLSCYWDFYRGILPKGVKLPNNKYDRKRKASVQGHKQLSAKSISKLEQKYGGKSLTVSMPLATSKACNGDDVSCPPWEFGCCDNARFNLQSFFPINWSKELEKKAEEVVCSYDLRENSDGSLCCPLCHGDNHEAVNTQLQQAATRRTSNDNFLYYPTALEVHADKCEHFQKHWVRGHPVIVRDILWRTSDLNWDPVAMFCTHLDGSIAKCENEKEASKASPCLEWSEVEISMRQSFIGFRGKARESIRHEKLEIKSWLSSRYFREQFPAHYAEILSALPLQDYMNPDLGRLNLATMLPLENMSAEIGPYVYISYCSPNEHPSEHFGSKLCYDLCDVMMFRRTKLIESKLMRKRQAQDKKESTGAPNGELLGSDIENSSEVLDVSIEEMQIRKKMAKVTWLATASEESPCLIAQDNKQKQDHNSTSMEDIQQNLYENQTESHSHYMKKVGKSCGAQWDVFRREDVPKLEEYFRRYSAEFMQPCGSQKHVVHPILDQCYFLDEYHKLRLKEEFEIEPWTFEQHVGEAVLIPAGCPYQIRNPKSSVNVILHFISPESAAECIHLIDELRLLPEGHEARLDKLEVKKMAVSSLTRAIDEIRELTSVKDNAEA

SEQ ID NO: 3608 - protein, 188 aa, Eucalyptus sp.; identical to SEQ ID NO: 1091

SEQ ID NO: 3609 - protein, 222 aa, Eucalyptus sp.; identical to SEQ ID NO: 2092

SEQ ID NO: 3610 - protein, 222 aa, Eucalyptus sp.
MVRGKTQMRRIENKTSRQVTFSKRRNGLLKKAFELSVLCDAEVAAIIFSPTGKLYEFSTSSMSSIIERYQRKTKDPGCSEKTTEIDLQNMKGNSLDMAKMIELLNVSNSRLSGELSDTCSVEELQSTQNLLERSLSKIRARKNLLFKEQIMLLKQEEKKLLDENKKLRSKNEVRGPLKFVTEHPEVPRGQGLDVETELSIGCPQRHRLNIHPHEEGLSIHWL

SEQ ID NO: 3611 - protein, 228 aa, Eucalyptus sp.
MVFPTQATPEESPQRKMGRGKIEIKRIENTTNRQVTFCKRRNGLLKKAYELSVLCEAEVALIVFSSRGRLYEYANDSVKATIERYKKACSDSSSSGSVSEANVQFYQQESAKLQQQINNMQNNNRQLVGDSIAGMNMKDMKTTEQKLEKAIAKIRAKKNELLFAEIEYMQKREIDLHNNNQVLRAKIAESERTQHADMNLMPGGANYDFMQPSSSQPFDSRNYFQVNV

SEQ ID NO: 3612 - protein, 233 aa, Eucalyptus sp.; identical to SEQ ID NO: 1112

SEQ ID NO: 3613 - protein, 246 aa, Eucalyptus sp.
MGRGRVELKRIENKINRQVTFSKRRNGLLKKAYELSVLCDVEVALLIFSSRGKLYEFGSAGPSGINKTLERYQRDNFTPQDNVAEHETQQNWFQEISKLKAKYESLQQTQRHLLGEDLGQLNVKELQNLEKQLEQALAQARRRKTQLMLEQMDDLRKKERQLGDLNKKLKSQLEAEGLNLKAIQALWTSTSDAAGTSSFHVHHSQRIPLDCEPQPVLQIGYQYAQAEGSSVTKSGTGETNFIQGWV

SEQ ID NO: 3614 - protein, 251 aa, Eucalyptus sp.
MEFPSEFSEASSQKRIGGRGKIEIKRIENTTNRQVTFCKRRNGLLKKAYELSVLCDAEVALIVFSSRGRLYEYANNSVRGTIERYKKASSDSSHPQSVSEVNTQFYQQEASKLRRQIREIQVSNRHILGEGISDLSFKDLKNLESKLEKSISRVRSKKNEMLFAEIEYMQKREIELQNDNMYLRAKIAENEGAQQQQQQGSDHHFNMPGSSSVYEALPSQPAYDRNFLQVNVLEPNHQSYSRSDHTALQLV

SEQ ID NO: 3615 - protein, 242 aa, Eucalyptus sp.
MGRGRLQLKRIENKINRQVTFSKRRAGLLKKAHEISVLCDAEVALIIFSAKGKLFEYSTDSCMERILERYERYSYSEHQVLASETESIGSWTLEHAKLKARLEVLHRNYRHFMGEDLDSLSLKDLQNLEQQLESALKHIRSRKNQLMHESISVLQKKDRALQEQNNLLTRKVKEKERALAQQAQWEQQDHALDSPVVLPHYLPSLDINGSYQARHNGHDDGENLTQPRAGTLLPPWMLPRLN

SEQ ID NO: 3616 - protein, 97 aa, Eucalyptus sp.
MYIPRTATDKAPRICKSSSHYSLMADSEHSSSDDTYVDSREETSEESKLDFSEDEETLVIRMYNLVGERWSLIAGRIPGRTAEEIEKYWNSRYSTSQ

SEQ ID NO: 3617 - protein, 195 aa, Eucalyptus sp.
MDKKPDDDSGKSQDVEVRKGPWTMEEDLILINYIANHGEGSWNSLAKAAGLKRTGKSCRLRWLNYLRPDVRRGNITTEEQLLIMELHAKWGNRWSKIAKHLPGRTDNEIKNFWRTRIQKHIKQAEAFSGQSSEMSDQASTSHMSSMPEPMETYDSPPSFQGNNNMEPLPVNLSVESNEAYWSMDDLWSMQLLNGD

SEQ ID NO: 3618 - protein, 301 aa, Eucalyptus sp.
MGRSPCCEKAHTNKGAWTKEEDQRLIDYIRLHGEGCWRSLPKSAGLLRCGKSCRLRWINYLRPDLKRGNFTEEEDELIIKLHSLLGNKWSLIAGRLPGRTDNEIKNYWNTHIKRKLVSRGIDPQTHRPLNSAAPGVPPAATSPPSLPVTEISLISSSLHRRPHSNDYYGREKLEPKAEPLREDNHCTTSSGTTTDEELKAPRNRQQAQGGSELNLELSIGLAPSCRELNRNASSVTANTAESKLQEVPYPLLTVPTPAAAAAAAAAAAVCLCCQLGSRSGGMCGNCQSNGGSFGYYAQLGS

SEQ ID NO: 3619 - protein, 330 aa, Eucalyptus sp.
MGRSPCCESEHMNKGAWSKEEDERLIAYIKRHGEGCWRSLPKAAGLLRCGKSCRLRWINYLRPDLKRGNFSDEEDELIITLHSLLGNKWSLIAARLPGRTDNEIKNYWNTHIKRKLHARGIDPQTHRPLDYTSTAGAGAAATHTICSNANNSGNKATPHSTTCEELSSSSTPPPLRAAKKRLNSLASAVVTVREEEESTNNSMSSDVTTTTTTTAEEVQVQLINNKNGINMDEDGDANADLDLSLCLSVHRPKTIIRNNSTSSTASTELLRSPPPLPAHGHREVFLSLGFHPDARHACSGTSCSAPTATTLDLLSDPSSHPISGASSYWF

SEQ ID NO: 3620 - protein, 356 aa, Eucalyptus sp.; identical to SEQ ID NO: 1183

SEQ ID NO: 3621 - protein, 208 aa, Eucalyptus sp.
MDKKPCYRTQDPQVRKGPWTLEEDLILMDYIANHGEGVWNSLAKAAGLQRTGKSCRLRWLNYLRPDVRRGNITPEEQLLIIHLQSMWGNRWSEIAKHLPGRTDNEIKNYWRTKIQKHIIKQSETEINDLTIPPSSANACTDHRGVSAANTIEIACSPPSDQGGSGETMLSALPPAQEPNDSACWSVEDLWPIQSLISGMGDDAQYYSV

SEQ ID NO: 3622 - protein, 306 aa, Eucalyptus sp.
NDERLINEDMNSNASSNPQSMATSTTSATTPAAGGDGGKKVRKPYTITKSRESWTEEEHDKFLEALQLFDRDWKKIEDFVGSKTVIQIRSHAQKYFLKVQKNGAVAHVPPPRPKRKAAHPYPQKASKNVLVPLQASMAQPSSTNPAFTITPGNVSWDDASVLINNASSNNMLSQDEFSNFQADIGSKGSSRVSCSTAAGVRSSSRTPSSLEISKQKRQTPVMHGIPDFSEVYGFIGFDPNAKGHVQKLKEMDPINFETVLLLMRNLTFNLSSPDFVPVRKVLSSYDVNTKTVGAPLENVVQSDLTC

SEQ ID NO: 3623 - protein, 301 aa, Eucalyptus sp.
MGRSPCCEKAHTNKGAWTKEEDQRLIDYIRLHGEGCWRSLPKSAGLLRCGKSCRLRWINYLRPDLKRGNFTEEEDELIIKLHSLLGNKWSLIAGRLPGRTDNEIKNYWNTHIKRKLVSRGIDPQTHRPLNSAAPGVPPAATSPPSLPVTEISLISSSLDRRPHGNGYYGREKLEPKAEPLREDNHCTTSSGTTTDEELKAPRNRQQAQGGSELNLELSIGLAPSCRELNRNASSVTANTAESKLQEVPYPLLTVPTPAAAAAAAAAAAVCLCCQLGSRSGGMCGNCQSNDGSFGYYAQLGS

SEQ ID NO: 3624 - protein, 326 aa, Eucalyptus sp.
MVSVNPNPAQGFYFFDPANTRIHGVNAGSAAEGGGAAPPYAEDPSKKVRKPYTITKSRESWTEQEHDKFLEALHLFDRDWKKIEAFVGSKTVIQIRSHAQKYFLKVQKNGTSEHVPPPRPKRKAAHPYPQKAPKAPVVSQVNGPFQVSSAFLEPGHIVRPDGSALLGNSRTSVALSSWSHNSVPAMSASQGTKDVGISGPPVPSNCCNSSSNDSTPRSWPNAQAIEPLDQQKHLRVMPDFAQVYRFIGVFDPDAGGHLQRLKQMDPINLETVVLLMKNLSANLTSPEFEKYQHGLFASYEGGPEKSKSGGSFKLLPEKSGSLILSA

SEQ ID NO: 3625 - protein, 370 aa, Eucalyptus sp.
MTRRCSHCCNKGHNSRTCPVRGGGGDGGGAAAAPSSSSPSTSSSGAAAAAAASASGGGVKLFGVRLTDGSIMKKSASVGCLSAAHYHSSSSAAASPNPGSSPIDGSDGYLSDDPAPGSRSSNRRVERKKGNPWTEEEHRRFLIGLQKLGKGDWRGIARDFVTTRTPTQVASHAQKYYIRQSNAGRRKRRSSLFDMAPDMATADQPSHPEETFLPPLVRLNDDTNSTTSTSMGLDLERTPMETSHPETSEGGGDVAMESIDQVPLVPCYFPYYLPLPFPMWPPNMAPPEDGRVVETSHHRVLKPIPVIPKEPLNIDQIVGMSQLSLAENEPAPLSLKFLGETSRQSAFIKAPSSVNESDLDNCKDGATQAA

SEQ ID NO: 3626 - protein, 414 aa, Eucalyptus sp.
MGRHSCCYKQKLRKGLWSPEEDEKLLRHISQYGHGCWSSVPKQAGLQRCGKSCRLRWINYLRPDLKRGAFSQDEEDLIIELHAALGNKWSQIAANLPGRTDNEIKNLWNSCLKKKLRQRGIDPVSHRPLSEVENSDDKDATSGQTQDKVSRGSVELLSQLNPQFSSSTTARSSKNSNLMAPTLSKDTVADGFVSNHQENSMMNSCISDFVDNFSLQQLNYSSSDSRFSNLCFTQTGRAHGNTIFSDFNSNVISAISPPSSNSLFPTASMGFNFKPSNAVPSANSTSSASTGTADFHNSGSYFGNSLVSWGLLADCGSPDKEGSTSIHPLEVHQPGDFKWAAEYLQNPLFMAAALQNQAQEQSNLYNQIKPETQFPPDHSTTSMWDHLQGHESLDNSLNTCGKDIQRLTALLGHN

SEQ ID NO: 3627 - protein, 243 aa, Eucalyptus sp.
MEVPRFFASAAGIKLPIGFRFRPTDEELVVHYLRRKVLAVPLPAAVIPELDVFGTDPGGLPGNLRERRYFFSRRNRSSGGRECIRVAAGFGYWKYKTKSKQILASDGTGNQVIGMRKTLVFCEGKRSACDAAGARWILHEFTIAGTRENSKSTSMARAGDENWAVYRLFQKKMRPKRSDNGNGDFSHRKRKKSSSVIDLRSEAIAGDSPDTPPPPSSPCSSSITDNGSSCKALDQEDISSSSR

SEQ ID NO: 3628 - protein, 282 aa, Eucalyptus sp.
MKGLSVSSGSGLPPGFRFHPTDEELIMHYLRNQATSRPCPVDIIPEVDIYKFDPWQLPDKAEFWENEWYFFTPRDRKYPNGVRPNRATVSGYWKATGTDKAIYSASKYVGVKKALVFYKGRPPKGIKTDWIMHEYRMTEVKGQAKKRSGSMRLDDWVLCRIYKKRATGKTLEPRIEESNHNVQATDKAYANLDATDPTMLKFPRTFSLTHLLEMDYLAPFSHILSDNPYSAIFDYQNTISSNNSANDSADQKPHGGHFPHHVAVQNSALNQNMVINPIFDLQ

SEQ ID NO: 3629 - protein, 363 aa, Eucalyptus sp.; identical to SEQ ID NO: 3593

SEQ ID NO: 3630 - protein, 359 aa, Pinus radiata; identical to SEQ ID NO: 3594

SEQ ID NO: 3631 - protein, 466 aa, Pinus radiata; identical to SEQ ID NO: 1352

SEQ ID NO: 3632 - protein, 314 aa, Pinus radiata
MDHHNHHQHHPSSSSGGAAPQGMSQGYPGGAAAQPSPVGMQGQAGQIVQTGLHQSGGQQAFHHHHMQQQQQQQQQLHMFWAFQMQEIEQVSDFKNHQLPLARIKKIMKADEDVRMISAEAPVLFAKACEMFILELTMRSWIHAEENKRRTLQKNDIAAAITRTDIFDFLVDIVPRDDLKEEGLGLGFARGGVTPEGSFYYPPPSMPQSPHQQGMMGSSSIMMGRPVPLQMDPSAMYMHQQQQPRPYGMPTHPHQPMWQHPHHPHQQQQQQQMPDGQSYGHPHQQQQQHMPDGQPYGQQQMTDEHSYGTSPRSAN

SEQ ID NO: 3633 - protein, 242 aa, Pinus radiata
MKPKKRSAGAVKGSGKKDPKDLKPVQKERVLRVKKNEGEQTGKGKGKIKGKGKGNDKSKGKGRQKQQHKEREKKTKTEKDPNLPKKPATAFFYYMEEFRKTYQKENPGVTGMREIGIACGIKWKELTYEEKAPYYDIATQKRAEYEKILAAYRKKKEAGEEVEAHEAPGKTNSVINDGKEGGEEAGKEVEAHQGPDETNSEINDDKEGGKEAGEEVEVHQEADETNLKINDDKEGGEQEDME

SEQ ID NO: 3634 - protein, 307 aa, Pinus radiata
MACDRSALYPSNVIMNTEDNSSANAIAAMIANSCTPPATFQGNRSMSVFETGNERKRPAGNSYSALELSDDIGDEDGSDDCIHLGEKKRRLTLEQVRALEKNFEMANKLEPEKKMQLAKALGLQPRQIAVWFQNRRARWKTKQLEKDFNILKHDYDSLKQNYDNLMEENNNLQAMIERLRNKSQSCHDQKFQANSSKLQKDDQDLPIFMMSATKVCANKENNNEGRSSIGSEGSSVLDMDSPSTIESQQNIDSIGFSNVKARDPRLECNFRPKVEESVIEADEPCNYLFYNNMESGPLLWEYNWSCL

SEQ ID NO: 3635 - protein, 831 aa, Pinus radiata
MATYFPGSNIQADNMQTLYLMNPGYAGYTDATTSGNMVLLNHSVGNTLPANNMAGGQPSQFIGIPLPTASLSQQRSSLGVMGNSPTAQQDINTNLLASRIGGHPYNVWRNGGNELTFMQTTDAAGSSQTLSGHLNNSGSMGHQPVAEISQLGLRRAPMSSIQEQQSGMLPSGLSLQLEHSHGSTGHGQGLSLSLSPQQPSTVQLPSFQNQPTDSDINCPGISATSEENISRTDRSTSKWAGSLSAFRASSRDGMLGSGFSNTGFSGNLLAPGANKQMHLDSSSTGAPGLSNVLIGSKYLKAAQQLLDEVVNVGKGIKPDSAKHQKSQSWIGTTANKENSGAEGGGKDGAAAAPTWRSTSAQETNDRPSELSPAERQELQMKKAKLVAMLDEVDQRYRQYYHQMQIVVSSFEAAAGYGAAKTYTSLALQTISRHFRCLRDAISGQIRLTSKSLGEEDSTVSGKGETSRLRFVDQQLRQQRALQQLGMIQQHAWRPQRGLPERSVSVLRAWLFEHFLHPYPKDADKHMLARQTGLTRNQVSNWFINARVRLWKPMVEEMYVEETKEAEVDHGSNDKTGKESGEKKEDALSKEGAAGNNGNIHEQQSGKISKLDNIAQDGGADEKPAGVPKSENASNLINVRNQSFGMGGTSDSQIFNETENEGIRQGQLKKARNGTQECTSLLSPNMSIEVDLKSDETNSGEFGDHKFSDERQNTEDYSFVHNAMVHPDNSGSFGSYQIGDLSRYGHESFTPRFSGSGGVSLTLGLQRTDGLSLQGAQQNYMSTQSLALGRRHDLGGNSSDYCNIETSAPHPANLYENINIQPRKCFATQLMH

SEQ ID NO: 3636 - protein, 197 aa, Pinus radiata; identical to SEQ ID NO: 1486

SEQ ID NO: 3637 - protein, 225 aa, Pinus radiata
MGRSPCCEKAHTNKGAWTKQEDDRLIAHIRAHGEGGWRSLPKAAGLLRCGKSCRLRWINYLRPDLKRGSFTEEEDELIIKLHSFVGNKWSLIAGRLPGRTDNEIKNYWNTHIKRKLLSKGLDPQTHRPLGQPNNTPVTRPVLEHEIPAFQNPATPEIADLLQHHRLESSPIKPAASDAEEHPDLNLNLCISLPSNSAPAVNRVSSVDTTVDSNSNSGDGLCWQFL

SEQ ID NO: 3638 - protein, 255 aa, Pinus radiata
MGRSPCCEKAHTNKGAWTKEEDDRLIAHIRTHGEGCWRSLPKAAGLMRCGKSCRLRWINYLRPDLKRGNFSEEEDELVIKLHSLLGNKWSLIAGRLPGRTDNEIKNYWNTHIKRKLLNRGLDPQSHRPLGQPHNSNTTCPSLPALEHEILVFQRPRTPEIADFFQYERSESSPMEPATSKDAEEHPDLNLDLCISLPVHSPPATSRASSVDGTVDSKPNSVSCHMGLQVNYGVQCENRYCEESASGVSSFYTLVL

SEQ ID NO: 3639 - protein, 304 aa, Pinus radiata
MGRSPCCAKEGLNRGAWTKTEDIILSEYIRIHGDGGWRSLPKKAGLKRCGKSCRLRWLNYLRPDIKRGDISPAEEELIIRLHRLLGNRWSLIAGRLPGRTDNEIKNYWNTRLSKKLLLSMNKSQCKSRKNLKSKAKPSPIQNRVFKTTPVKITTTVRLSGTATPNGSMNGYGRSNPSSDKASKLCNVKETTNSSKSWCEHLGIDTDAAISTSSMSSLPLERSPHSYYFGADAAPLAESLLDLNELGLTVSDDQRIEEFYDHTQHLDWIHELDYAEGPSPQSLSLLLLESDDEREERLGDHGQIP

SEQ ID NO: 3640 - protein, 327 aa, Pinus radiata; identical to SEQ ID NO: 1552

SEQ ID NO: 3641 - protein, 340 aa, Pinus radiata
MGRQPCCDKVGLKKGPWTAEEDRKLVNFITLHGHGCWREVPKLAGLLRCGKSCRLRWTNYLRPDLKRGLLSESEEKLIIDLHAAIGNRWSRIAAQLPGRTDNEIKNYWNTRIKKKLRQMGIDPVTHKPLTQMQMQSTPAQTLLLQENDTEQQQQEQHNEPDPDQNQSSNGTVETLVSRAREPHDDIEPLQNFNMEDSNFNMEDSMQLFNVCSPTSGISLSGRTEEVDSDDSDQVSKSFGNGSSTHSQYIGRETSGVKAECGLSGWDQMAGVLGDPLSEWNVDLEAWAAGLDAPAASASAWIQQLPDCQWNDFQGDFEICSSKSCPETLQRLGPFLDDDEL

SEQ ID NO: 3642 - protein, 374 aa, Pinus radiata
MAMSNGRLCEDLDRIKGPWSPEEDASLQRLVQKYGPRNWTLISKGIPGRSGKSCRLRWCNQLSPQVEHRPFTPSEDAAILQAHAQHGNKWATIARALPGRTDNAIKNHWNSTLRRRCRDPEKGIVVHLDDEISSLDAARKRSSDGFSHDGSSALEDNGCSSWEVDSKRLKRLGELGTEQGPEVEAEVEVSDRSDANPGRVLYRPVPVVSFFSSFGKTVANLQETAAGAVGVDPPTSLSLSLPGLDPAIPSPKLSTQKDSHNNSTVNNNIPIPPVVEYMRADEAVVERLSTAVKATVASMLTPVLNSSPRGYNPPAVSSDLLALMRDMVAKEVQKYMSSHHQPGMYTPLSPHPEFLGAANLVRNVVLGGALHLNK

SEQ ID NO: 3643 - protein, 374 aa, Pinus radiata; identical to SEQ ID NO: 3642

SEQ ID NO: 3644 - protein, 321 aa, Pinus radiata
MTQKGGTGGQIDLPPGFRFFPTDEELVVHYLCKKVVSHPLPAFIIGDVDLYKYDPWDLPEKALFGEKEWYFFTPRDRKYPNGSRPNRAAGSGYWKATGADKPITTCGGRKRVGVKKALVFYKGKAPKGSKTNWIMHEYRMAEINMAARKKNTLRLDDWVLCRIYNKKSSAERLEEKKLAEEMESCHDMQETVGLHDMQETVEQQKKTQSVPSEPSPTDASTVSAEAGLPSTNSSLFNPHLPAPPMNPFCQQQSTTTDEVQMNIKLANQLIQKQQQSGQCLNFNLGLDIVQSPFFQLDNSEPSSLFNPYQEFMDNYSIQRSY

SEQ ID NO: 3645 - protein, 472 aa, Pinus radiata
MVGRGAWSSRRRSVDSGSGNSMKSSSKRRVRRGPREGTEEDEETKESEGEEQEHDEEQQQEEEDEEEQGEEESENGQVLGEGFYEVEDIRKKRIRKGQVQYLVKWRGWPETANTWEPYDNVKSCADVVQAFEDSYGGRISKPGRKARRKSGFPFSHQKRKRVSLSSADEGAEAEAEVETEAKRAKTSYFGDSQISGKSEVEVEPQQLHGSGVGTVSEQCHPEKDDGAQSHIPEKEGKETEEQNGGKDVTNSVEEEAENKTEDQNPQQEEPTSEDHTKNGPPPSPEDARCAEEKEMAVDESKPDQGAAVNDSSRHIQTTQFTGAKKRKSGFVRRVKQALDSREHELKQGEENSNSQPAKEMFVENSKAQEANAVGNGEEIKSQKPSIAGLHSNANNKSSNSPDSALTLAITRILKAISYNNSTSNNKQDVSVLFKAQRADGQEVVVDNKFLRANYPLLLIDFYEQHLRYSTAQ

SEQ ID NO: 3646 - protein, 1147 aa, Pinus radiata
MDGKAGPQVATPFFQHQLLSGPLYEPSLGAKRCVEPADSSWTRTNWQHQQQQKSPPVYEAPKPNWNVNVWDWDSVRFIAKPADLANHREPNPSNIKPQASPEILRLGSNDIGSNVVNGPSFPDQKRKLDEPPKPFLPGKDSSENDPGNLTLKLGGSSYSYADDTNPSRQNKRVRSGSPGSAYPMCQVDDCRTDLTSAKDYHRRHKVCETHSKASKALVGSLMQRFCQQCSRFHPLQEFDEGKRSCRRRLAGHNRRRRKTQPEDALPRGLLAASQENGGLGNLDIVSLVSILSRLQGNNSSMEKSNGQSSLDGDQVVQLLNRMNSSFPSSQKVAPPSEGFDLNIAQNLQSPRSEVPKANGSPSTGLTTELLAILSALTGPSHDALALLRNSLATNLKGNLKAHHQNVLPPSPTPVAQQKPQERDIQNQKTNLIVDSGANNRKINATYQDNSRTHLPLRLFNSLEEDNSPPNAFTRKYFSSDSSNPTERSPSSSPPVVQNLFPLHSGDESRENDCVSVCKEDNLTLETSPSNDRCSAYELSKLESRVHNQNFMSGFLHQSLESRTAVVQPSYTSSSGSDQSPASSNSDSQERTGRIIFKLFGQHPSNFPVALRAQILEWLSHSPSDMESYIRPGCVILSIFVSMPSANWERLREDLPQRLKLLVEDSRTDFWRCGRVLVQAEQRLASSNDGKVRFCSSWRSWDAPEIYFVQPVAVVAGQETTITLRGHNLATTGTKILCAYRGKYTSIDVLPEEEASECIPTDSRVQKFTFSGGPPNVLGRCFIEVEHGFKGNCFPVIVADPIICRELQSLESEIEIEFSSDKTSSIKVERSQEHFQGYSAATARDEVIRFLNELGWLFQKSSERQAELNVVKDASFLEFSSDRFKFLFIYAVERDMCALLKKLLDIFFEMNAGQEASAPESSKNLLESNLLHRAVKRNCKQMVDLLLNYAPSPNNMNLLQTKSFIFPPNLTGPGGLTPLHLAASIRNSEPLVDALTSDPQDVGLQSWSTALDSSGQTPHAYALLRNNHSYNRLVERKLADRKYGQVSITISNNEPSLDGIAADVNGSHTGSSVLSLQKLPQSCAQCMIFSNKRVRRITGSPGALYRPYMHSILAIAAVCVCVCLYFHGPPHVGSSGPFKWENVDFGPA

SEQ ID NO: 3647 - protein, 364 aa, Pinus radiata
MASKLYMKQRIMDPVNISLSLNIQRDCDVQIMSRAGLDSAQRMVSILSQKHQQNQQEQVQQEFVLAAEDALSKLNKVVSLLSRKGHARVRRGPLQTQSASGSGSEQLFMDGPNFLDLESPKTHASASIYSSSSSDFALSQCVKQFLPCQSSSSGVLSADTNRHQQLHPQMHYPPLQLQHLSPQAEVMFRNGYMQLDNSMSCTATISSTKSFMSSLSMDGSIANDKQLLQYQSISAAQERIPGASSKRKCSGKGDDSSKCGSTGRCHCSKRRKLRVKRTIRVPAIRSKLADIPPDEFSWRKYGQKPIKGSPHPRGYYKCSNLRGCPARKHVERSLEDPSMLIVTYEGEHNHSRLLSSNSSLIVHP

SEQ ID NO: 3648 - protein, 293 aa, Eucalyptus sp.; identical to SEQ ID NO: 1361

SEQ ID NO: 3649 - protein, 251 aa, Eucalyptus sp.; identical to SEQ ID NO: 3614

SEQ ID NO: 3650 - protein, 717 aa, Eucalyptus sp.; identical to SEQ ID NO: 1593

SEQ ID NO: 3651 - protein, 243 aa, Eucalyptus sp.
MDGGGQYNPRTVEEVFRDFKGRRAGMIKALTTTQEKENLCLYGFPNEKWEVNLPAEEVPPELPEPALGINFARDGMQEKDWLSLVAVHSDAWLLSVAFYFGARFGFNKADRKNLFAMINDLPTIFEVVTGTVKKQTKEKISVSNHSSSKSKSGSKVRGSDSGKFTRTIQAKDEDDVVDGEDEEEHGDTLCGACGENYASDEFWICCDMCEKWFHGKCVKITPARAEHIKQYKCPSCSNKRVRT

SEQ ID NO: 3652 - protein, 252 aa, Eucalyptus sp.; identical to SEQ ID NO: 2078

SEQ ID NO: 3653 - protein, 229 aa, Eucalyptus sp.
MVFPTQATPEESPQRKMGRGKIEIKRIENTTNRQVTFCKRRNGLLKKAYELSVLCEAEVALIVFSSRGRLYEYANDSVKATIERYKKACSDSSSSGSVSEANVQFYQQESAKLQQQINNMQNNNRQLVGDSIAGMNMKDMKTTEQKLEKAIAKIRAKKNELLFAEIEYMQKREIDLHNNNQVLRAKIAESERTQHADMNLMPGGANYDFMQPSSSQPFDSRNYFQVNVL

SEQ ID NO: 3654 - protein, 233 aa, Eucalyptus sp.
MYGRAAEWSRYEDKVFEHALVAVAEDSPDRWQLIGNRLNRSASQVFEHYQRLVEDIDAIESGRVEPPSYRDDHPASCGQIAFETKPRIKEAEKKKGNPWTEEEHRRLFLLGLQTYGKGDWRSISRHFVLTRTPTQVASHAQKFYMRQMSLGKKERKRNSIHDITTVDTPPVPASVNDSFNPPQAGNAQDDPSYDYPKANNFQQMQPCQPAPFMNQLLDQGGGSIGYENLSYFL

SEQ ID NO: 3655 - protein, 730 aa, Eucalyptus sp.
MDTYSSGEDLLIKQTRKPYTITKQRERWTEDEHNRFLEALKLHGRAWQRIEEHIGTKTAVQIRSHAQKFFSKLEKEAIVKGVPVGQTLDIKIPPPRPKRKPSNPYPRKTGAITPTLSVGAKDGGILSVSPSNCEKLDSETAPFLERASGGEKLANSKENQDDNCSEVFNLPQEAHCSSISSTNRSVVPTPVGIQNSCTFRKFVPSLKEDNGPRKVSNSENSDRSHEKSVQCRMDGYDGPPADEMQTAHNFPRHVPVHVLDANHTKCTQAPLQDVSFQDSAFDPTGEVKARLNLFPNQTPSAAGENQKEAPRMDHQSFPAFHPPFTPVHHNEDDYRSFLHLSSTFSSLIVSTLLQNPAAHVAASFAASLWPYPNVENSVVDSAVCTQGTFPCRPSSSPPSMAALAAATVAAATAWWAAHGLLPLCAPLHTGFTCNPTSATAVHSLNTSQTPGVEKERRECTFENPCSQEHLDPEHSEALQAQNSASKSPLGALSDSEDSGGARLDTRSKAADHEKAAVETDSQQNQSKGGKPVDRSSCGSNTPSSSEVETDALEKQEKGNETLKDPDPNQSILEYFNRRCRSTSNVTDSWKEVSEGGRLAFQALFSRNVLPQSFSPPRDMKNKGQQKENVEEGEQNNGEVDKDVSTLDLNRNMCISCSFHQGSERSGVIDDGEEGLLTIGLGQGKLRTHRTGFKPYKRCSVEAKETRAANVGSQSEEQGPKRIRLEGEPSM

SEQ ID NO: 3656 - protein, 252 aa, Eucalyptus sp.
MVQEVRKGPWTDQEDFQLVCFVGLFGDRRWDFIAKVSGLNRTGKSCRLRWVNYLHPGLKRGKMTPQEERLVLELHSKWGNRWSRIARKLPGRTDNEIKNYWRTHMRKEAQEKKHALSSSSASSNISSSSSNNPTVDSLTTQETGKESFYGTGGPGDMLTSTEQNIEEQGKSESACSFDDIWKEIALADGYGILPVYDGYSEESCNFSCPPMASPTMEYNSDPLWLTDEEESKMFPINQFIPDYEHGGAYITG

SEQ ID NO: 3657 - protein, 356 aa, Eucalyptus sp.; identical to SEQ ID NO: 1183

SEQ ID NO: 3658 - protein, 327 aa, Pinus radiata
MVSVNPNPAQGFYFFDPANTRIHGVNAGSAAEGGGAAPPYAEDPSKKVRKPYTITKSRESWTEQEHDKFLEALHLFDRDWKKIEAFVGSKTVIQIRSHAQKYFLKVQKNGTSEHVPPPRPKRKAAHPYPQKAPKAPVVSQVNGPFQVSSAFLEPGHIVRPDGSALLGNSRTSVALSSWSHNSVPAMSASQGTKDVGISGPPVPSNCCNSSSNDSTPRSWPNAQAIEPLDQQKHLRVMPDFAQVYRFIGSVFDPDAGGHLQRLKQMDPINLETVVLLMKNLSANLTSPEFEKYQHGLFASYEGGPEKSKSGGSFKLLPEKSGSLILSA

SEQ ID NO: 3659 - protein, 335 aa, Pinus radiata; identical to SEQ ID NO: 1180

SEQ ID NO: 3660 - protein, 370 aa, Pinus radiata; identical to SEQ ID NO: 3625

SEQ ID NO: 3661 - protein, 328 aa, Pinus radiata; identical to SEQ ID NO: 1178

SEQ ID NO: 3662 - protein, 327 aa, Pinus radiata; identical to SEQ ID NO: 1460

SEQ ID NO: 3663 - protein, 225 aa, Pinus radiata; identical to SEQ ID NO: 1519

SEQ ID NO: 3664 - protein, 1158 aa, Pinus radiata
MEQQRQQQQQQSRWPYVEAQVPAPPNLMASADIARLLPEDALLSELMEMDGLMDTISEPWPAMASESGFSNFNFSSFIASPDSSSSFYAVCSPSAPFNAQPSGLVRADSGAMYSLPCNSSGFSPSMVNSSTTSLPQLILQEDVLMASASQDIPDKQIDDVRRSLSPSTSWEQRICKDLSSKHQEATFEQSVLDFVASDSSASEQQKQQDIMKGNFRHQLTNRPSGTVNGPRNDMNFWHLSPSLAERMHAALSFLKENYGVSVLAQVWMPVRQGERFYLTTREQPCILGGGLSGYRQVSTAYTFAAEEAPDDFPGLPGRVFMREMPEWTPNVQFYNKNEYLRVNDARDYNVRGSIAVPVFERDSRKCVAVVELVTTTEKFNFNKDIDNLCHALQKVNLRSKEIWHHPKSEHQRYSNSKCRETALAEILEVLTAVCQTHKLPLAQTWVPFRHYEIPIGEVTNTGSYGRMFLALEDQACYVGDHGMQGFRDICAEHRLEKGQGVPGKAFESNQPYFANDVKNYNVMDYPLVHHARMFCISAAVAVRLRSTHTGSDDYVLEFFLPKDCNDSSEQQVLLNSLSITMQRVCRSLRTVSDSELKGDGNRGRDYAQNDCTNFPSVGMLQRSHVPAQREPNITSFPDNQFCQEKYLQEGAVGHNSHQRQEYTSKKKLERRRGTTEKNISLHILQQYFTGSLKDAAKSIGVCPTTLKRICRQHGIARWPSRKINKVNRSLEKLRGVIDSVQGADGTLKLNAITSDIMNAASMVQGLQMHSNILPSQGSWALWPSPEDFITRKVVPVGTAVPLEETTTHQKENLNNTTQTVISTGLESPLSLKAASEVHSGCDIHMQRPSADGSISSSKNDLLARHFRESAQQGSLAYMKGQLEITEKDKNVQGFVGHEIMRNSFSSVAPFGERHQPVTYISDTSDELNSILIAKTRGFAEGIVENCQQVGHQFQGGKHDSKSLKNVENGENLSLQDVDYQVTSKHSDFFVLTNSKEPKSADVEVLRQEQNLPGFSAMTNSSAGSGSSSSSLQGCDSSSPTVSGVDGLQRERHNKDESLVITVKAKYKEDMVRFKLPLSSGFSELCEEVAKRFKLVVGTFQLKYQDDDDEWVLLACNADFQECIDVMNFSGGHAIRLSVRDLVTVIGSSSGSCGDMLQC

SEQ ID NO: 3665 - protein, 1147 aa, Pinus radiata; identical to SEQ ID NO: 3646

SEQ ID NO: 3666 - protein, 1115 aa, Pinus radiata
MEAEIGRSHCEDQIYQQQKQQQRQLYASKGYNLMSKGKNIVEDHEWDGNNWEWDSNLFIARPLSTDRGSGFQGKHLLSDGPRPANGISNDMYNKGGDAYTNGFHSYNMNDASEKRRKVSVVEEEETAEEEAAACLTLKLGGSDYPVTETDADAASGGSKNGKRSRGLSASSHHHPMCQVDDCKADLNNAKDYHRRHKVCEMHAKANKALVGRLMQRFCQQCSRFHLLQEFDEGKRSCRRRLAGHNRRRRKTHPDGIMAGTCLNDDRGSYSLIVNLLKVLAQLQTSNNSDQTSNQDTVLQLLKKLASSASIPEETNAAAAKQSTAGQPNNKVSLGGPSENTVPLQNNFLDSHSNAFRKSTEPSICAREQSFVSTQTRNDVLFPHDSAQKTAVSVVPQYSHKFWQRREGIQEQHVLAGSAPQSLSIESTDKRKSPISNGFDLNNVYNGPEELVPRSDGPSTLLLLGGLDSVSRQNAPLCSSWAASDTYQTSPPQISDNSESVSDQSPSSSQGDGQDRTGRIVFKLFGKNPSEIPQVLRSQILDWLAHSPSDIESYIRPGCVVLTIYLCLSESLWEEFARGFKISLERLLGVSNSDFWKTGWIFAQLDHQIAFIYNGQVLLDISSNFANAPLLLSVTPIAVPAGEKAHIVVKGRNLTSSTSRIICAFQGKHTVQKDSTEYVQDVGVPFIDGSDDFEGCTQILCRSFSWSPHNVIGRCFIEVEGHDMSGNFFPVIVAEADVCAEIRTLERYIDMPFNSNQDVTSQNHDLQLKIKREAIKFLHELGWLFQRSCSSQSNLGILPLTRFSPTRLKWLLEYSTEHDWCSVVRKLLNIVFSSNVNSANWSAITMLIEVGILHIAVRRNCREMVEFLLTYVPESVAEETMLTAGQGQAELSSNGFVFKPDMPGPAGLTPLHIAASMENAEGVLDALTNDPGQIGVKAWTIVRDKTGMTPEDYALLRGHHFYIELVRGKSVKNVMPEHVSLDIPEPLSQQLSSIKMSVSAPRSTSQAEKIGEGNIQGNKADTELCQKIRWPGGLSWPGGLRSDQGKIKPLPSHCKLCEQQQLRKYRSRTLIYRPAMLSMMAIATVCVCVTLLLKGPPEVLFVTAPFRWEVVKFGFM

SEQ ID NO: 3667 - protein, 20 aa, Artificial Sequence
  Illustrative conserved amino acid motif
  misc_feature (2)..(9): Xaa can be any naturally occurring amino acid
  misc_feature (11)..(15): Xaa can be any naturally occurring amino acid
  misc_feature (17)..(19): Xaa can be any naturally occurring amino acid
CXXXXXXXXCXXXXXCXXXH

SEQ ID NO: 3668 - protein, 4 aa, Artificial Sequence
  Illustrative conserved amino acid motif
MADS

SEQ ID NO: 3669 - protein, 6 aa, Artificial Sequence
  Illustrative conserved amino acid motif
  misc_feature (4)..(4): Xaa can be any naturally occurring amino acid
RWPXRK

SEQ ID NO: 3670 - protein, 4 aa, Artificial Sequence
  Illustrative conserved amino acid motif
WRKY

SEQ ID NO: 3671 - protein, 7 aa, Artificial Sequence
  Illustrative conserved amino acid motif
SHAQKYF

SEQ ID NO: 3672 - protein, 4 aa, Artificial Sequence
  Illustrative conserved amino acid motif
RAYD

SEQ ID NO: 3673 - protein, 28 aa, Artificial Sequence
  Illustrative conserved amino acid motif
  misc_feature (2)..(3): Xaa can be any naturally occurring amino acid
  misc_feature (5)..(24): Xaa can be any naturally occurring amino acid
  misc_feature (26)..(27): Xaa can be any naturally occurring amino acid
CXXCXXXXXXXXXXXXXXXXXXXXCXXC

SEQ ID NO: 3674 - protein, 25 aa, Artificial Sequence
  Illustrative conserved amino acid motif
  misc_feature (2)..(5): Xaa can be any naturally occurring amino acid; this region may encompass 2-4 Xaa repeats
  misc_feature (7)..(9): Xaa can be any naturally occurring amino acid
  misc_feature (10): Xaa can be Leu, Ile, Val, Met, Phe, Tyr, Trp or Cys
  misc_feature (11)..(18): Xaa can be any naturally occurring amino acid
  misc_feature (20)..(24): Xaa can be any naturally occurring amino acid; this region may encompass 3-5 Xaa repeats
CXXXXCXXXXXXXXXXXXHXXXXXH

SEQ ID NO: 3675 - DNA, 25 bp, Artificial Sequence
  Synthetic polyT oligonucleotide
ttttttttttttttttttttttttt

SEQ ID NO: 3676 - protein, 222 aa, Artificial Sequence; identical to SEQ ID NO: 1294
  Synthetic construct pFOR293

SEQ ID NO: 3677 - DNA, 10 bp, Pinus radiata
caaaagtggg

SEQ ID NO: 3678 - DNA, 10 bp, Pinus radiata
taccagtacc

SEQ ID NO: 3679 - DNA, 10 bp, Pinus radiata
acaagtggaa
